US012734201B2

(12) United States Patent
Espadaler Mazo et al.

(10) Patent No.: US 12,734,201 B2
(45) Date of Patent: Sep. 15, 2026

(54) PROBIOTIC COMPOSITION FOR THE TREATMENT OF COVID-19

(71) Applicant: AB-BIOTICS, S.A., Sant Cugat del Valles (ES)

(72) Inventors: Jordi Espadaler Mazo, Sant Cugat del Valles (ES); Ariana Salavert Larrosa, Sant Cugat del Valles (ES); Sergi Audivert Brugué, Sant Cugat del Valles (ES); Miquel Àngel Bonachera Sierra, Sant Cugat del Valles (ES)

(73) Assignee: AB-BIOTICS, S.A., Sant Cugat del Valles (ES)

( * ) Notice: Subject to any disclaimer, the term of this patent is extended or adjusted under 35 U.S.C. 154(b) by 364 days.

(21) Appl. No.: 18/264,703

(22) PCT Filed: Feb. 11, 2022

(86) PCT No.: PCT/EP2022/053332
§ 371 (c)(1),
(2) Date: Aug. 8, 2023

(87) PCT Pub. No.: WO2022/171779
PCT Pub. Date: Aug. 18, 2022

(65) Prior Publication Data

US 2024/0226199 A1 Jul. 11, 2024

Related U.S. Application Data

(63) Continuation of application No. PCT/EP2021/053539, filed on Feb. 12, 2021.

(51) Int. Cl.

| | |
|---|---|
| ***A61K 35/747*** | (2015.01) |
| ***A61P 31/14*** | (2006.01) |
| ***A61P 37/04*** | (2006.01) |

(52) U.S. Cl.
CPC ............ *A61K 35/747* (2013.01); *A61P 31/14* (2018.01); *A61P 37/04* (2018.01)

(58) Field of Classification Search
None
See application file for complete search history.

(56) References Cited

FOREIGN PATENT DOCUMENTS

WO WO-2011092261 A1 * 8/2011 .............. A61P 37/02

OTHER PUBLICATIONS

Dictionary definition "improve": https://www.merriam-webster.com/dictionary/improve retrieved Mar. 4, 2026.*

Anonymous, "History of Changes for Study: NCT04517422", Jan. 30, 2021 (Jan. 30, 2021), XP055816388, Retrieved from the Internet: URL: https://clinicaltrials.gov/ct2/history/NCT04517422?V_6=View#StudyPageTop [retrieved on Jun. 22, 2021] the whole document.

Spagnolello Ornella, et al., "Targeting Microbiome: An Alternative Strategy for Fighting SARS-CoV-2 Infection", Chemotherapy, vol. 66, No. 1-2 Jan. 1, 2021 (Jan. 1, 2021), pp. 24-32, XP055816387, CH ISSN: 0009-3157, DOI: 10.1159/000515344 Retrieved from the Internet: URL: https://www.karger.com/Article/Pdf/515344 the whole document; table 1.

Baindara P., et al., "Oral probiotics in coronavirus disease 2019: connecting the gut-lung axis to viral pathogenesis, inflammation, secondary infection and clinical trials", New Microbes and New Infections vol. 40 Jan. 6, 2021 (Jan. 6, 2021), p. 100837, XP055816389, GB ISSN: 2052-2975, DOI: 10.1016/j.nmni.2021.100837 Retrieved from the Internet: URL: https://www.ncbi.nlm.nih.gov/pmc/articles/PMC7785423/pdf/main.pdf.

Gutierrez-Castrellon Pedro, et al., "Efficacy and safety of novel probiotic formulation in adult Covid19 outpatients: a randomized, placebo-controlled clinical trial", medRxiv, May 24, 2021 (May 24, 2021), XP055816390, DOI: 10.1101/2021.05.20.21256954 Retrieved from the Internet: URL: https://www.medrxiv.org/content/10.1101/2021.05.20.21256954v1.full.pdf [retrieved on Jun. 22, 2021] the whole document.

Hu Jielun, et al., "Review article: Probiotics, prebiotics and dietary approaches during COVID-19 pandemic", Trends in Food Science and Technology, Elsevier Science Publishers, GB, vol. 108, Dec. 31, 2020 (Dec. 31, 2020), pp. 187-196, XP086473321, ISSN: 0924-2244, DOI: 10.1016/J.TIFS.2020.12.009 [retrieved on Dec. 31, 2020] the whole document.

Loren Violeta, et al., "Comparative Effect of the 13.1 Probiotic Formula in Two Animal Models of Colitis", Probiotics and Antimicrobial Proteins, New York, NY ; Heidelberg : Springer, New York, NY ; Heidelberg : Springer, vol. 9, No. 1, Nov. 10, 2016 (Nov. 10, 2016), pp. 71-80, XP036191555,ISSN: 1867-1306, DOI: 10.1007/S12602-016-9239-5; [retrieved on Nov. 10, 2016] the whole document.

(Continued)

*Primary Examiner* — Oluwatosin A Ogunbiyi
(74) *Attorney, Agent, or Firm* — Colson Law Group, PLLC

(57) ABSTRACT

A probiotic composition comprising *Lactobacillus plantarum* CECT 30292, *Lactobacillus plantarum* CECT 7484, *Lactobacillus plantarum* CECT 7485, and *Pediococcus acidilactici* CECT 7483 is provided. The probiotic composition is useful in treating, preventing, or ameliorating CO VID-19, and other infectious diseases. It is also useful in enhancing the immune response.

3 Claims, 7 Drawing Sheets

Specification includes a Sequence Listing.

(56) References Cited

OTHER PUBLICATIONS

Darbandi Atieh, et al., "The effect of probiotics on respiratory tract infection with special emphasis on COVID-19: Systemic review 2010-20", International Journal of Infectious Diseases, International Society for Infectious Diseases, Hamilton, CA, vol. 105, Feb. 9, 2021 (Feb. 9, 2021), pp. 91-104, XP086576980, ISSN: 1201-9712, DOI: 10.1016/J.IJID.2021.02.011 [retrieved on Feb. 9, 2021] the whole document.

Anonymous: "Immune Health I Ab-Biotics", Jun. 22, 2021 (Jun. 22, 2021), XP055816666, Retrieved from the Internet: URL: https://www.ab-biotics.com/products/immune-health/ [retrieved on Jun. 22, 2021] the whole document.

Anonymous: "Un probi6tico de cuatro cepas bacterianas aumenta anticuerpos IgG e IgM en pacientes positives para el COVID-19—Aula de la farmacia", Jul. 15, 2021 (Jul. 15, 2021), XP055847380, Retrieved from the Internet: URL: https://www.auladelafarmacia.com/probiotico-cepas-bacterianas-anticuerpos-pacientes-covid/ [retrieved on Oct. 4, 2021] the whole document.

* cited by examiner

PROBIOTIC COMPOSITION FOR THE TREATMENT OF COVID-19

FIELD OF THE INVENTION

The present invention relates to the fields of medicine and microbiology and particularly, to a probiotic composition to benefit human and animal health, particularly useful in the treatment of COVID-19 disease and other infectious diseases, and to increase antibodies directed at the SARSCoV-2 virus.

REFERENCE TO SEQUENCE LISTING APPENDIX

The present application includes a sequence listing appendix. The appendix contains an ASCII text file including a sequence listing, which listing is incorporated by reference in its entirety as follows:

REPLACEMENT 03-11-2024.txt 4,219,000 bytes Created Mar. 11, 2024

BACKGROUND ART

At the filing date of the present application, the webpage clinicaltrials.gov (clinicaltrials. gov/ct2/show/NCT04517422) discloses the design of a clinical trial with identifier NCT04517422 with title "Efficacy of *L. plantarum* and *P. acidilactici* in adults with SARS-CoV-2 and COVID-19". This disclosure was published Aug. 18, 2020. The sponsor and responsible party (the provider of the information) is AB-Biotics, S.A. The applicant of the present application is also AB-Biotics, S.A. Therefore, the discussed webpage publication may be considered as so-called "inventor originated disclosure" (i.e., the subject matter in the public disclosure must be attributable to the inventor, one or more co-inventors, or another who obtained the subject matter directly or indirectly from the inventor or a co-inventor).

The above-mentioned webpage publication reads (emphasis added): "Randomized controlled trial (RCT) to evaluate safety and efficacy of *Lactobacillus plantarum* CECT 7481, *Lactobacillus plantarum* CECT 7484, *Lactobacillus plantarum* CECT 7485 y *P. acidilactici* CECT 7483, one dose a day to reduce the risk of subjects with mild COVID-19 to evolute to moderate or severe disease."

Intervention Model Description: Randomized controlled trials. 300 subjects (18-60 years old) will be allocated to receive a combination of *Lactobacillus plantarum* CECT7481, *Lactobacillus plantarum* CECT 7484, *Lactobacillus plantarum* CECT 7485, and *P. acidilactici* CECT 7483 (branch one) or placebo (branch two)." "Experimental: Probiotics Active test product contains four lactic acid bacteria strains with Qualified Presumption of Safety (QPS) status by European Food Safety Authority (EFSA): *Lactobacillus plantarum* CECT 7481, *Lactobacillus plantarum* CECT 7484, *Lactobacillus plantarum* CECT 7485, and *Pediococcus acidilactici* CECT 7483 . . . ."

The present application relates to the combination of *Lactobacillus plantarum* CECT 30292 (also referred in this description as DSM 33765), *Lactobacillus plantarum* CECT 7484, *Lactobacillus plantarum* CECT 7485 and *Pediococcus acidilactici* CECT 7483. This combination is not disclosed in the above-mentioned publication at the filing date of the present patent application.

With respect to use of a probiotic composition for the treatment of COVID-19, the above-mentioned publication does not disclose any significant experimental data, i.e., the combination related statements may be seen as mere statements that are not supported by any significant verifiable experimental data.

WO2011092261A1 discloses a probiotic composition formed by *L. plantarum* CECT 7484, *L. plantarum* CECT 7485 y *P. acidilactici* CECT 7483 for the treatment of gastrointestinal diseases or conditions such as Inflammatory Bowel Disease, Irritable Bowel Syndrome or abdominal distension and bloating.

Coronavirus Disease-19 (COVID-19) is caused by the novel coronavirus 2 (SARS-CoV-2, formerly known as 2019-nCoV). SARS-CoV-2 infection may be asymptomatic or it may cause a wide spectrum of symptoms, ranging from mild symptoms (e.g., mild-to-moderate dyspnoea, fever and/or headache, with non-pneumonia or mild pneumonia) to severe symptoms (e.g., severe dyspnoea, partial pressure of arterial oxygen to fraction of inspired oxygen ratio <300, and/or severe pneumonia), sometimes up until critical symptoms (e.g., respiratory failure, septic shock, and/or multiple organ dysfunction or failure leading to death). Particularly, low arterial oxygen saturation has been repeatedly shown to be a risk factor for disease progression and later death, regardless of other symptoms.

Therefore, in order to avoid progression to more severe disease, it is of great interest to ensure fast remission of mild individuals, which constitute the majority of cases. However, effective treatments for people with mild to moderate disease have been more ambiguous. For instance, the anti-inflammatory effect of corticosteroids has been found beneficial in severe COVID-19, but it is thought its effects could actually worsen clinical outcomes in patients with mild or moderate disease.

Strains of *L. plantarum* have been previously shown to be beneficial in respiratory infections. [Chong et al. 2019], However, it has been clearly shown that effect intensity of different strains of *L. plantarum* on immune cells has a wide range of variation [Meijerink et al. 2010], A recent study has reported that drug therapy (hydroxychloroquine, antibiotics, and tocilizumab, alone or in combination) along with a probiotic mixture shortens the overall duration of symptoms in patients positive for COVID-19, who already showed moderate-to-severe symptoms and had required hospitalization. Further, the study was not randomized, and no effects on disease remission, reduction of viral load or potentiation of antibody response were reported in this study [D'Ettorre et al. 2020], Strain *P. acidilactici* K15 was also recently studied for prevention of common cold and influenza in preschool children during the common cold and influenza season. However, limited effects were reported in the study, since the probiotic was unable to shorten the duration of fever or the incidence of influenza in the overall study population, and only managed to shorten the duration of fever in those subjects who consumed very few fermented foods. Moreover, this probiotic was unable 5 to boost the levels of antibodies specific for influenza. [Hishiki et al. 2020], Probiotic features are strain-dependent, even among bacteria of the same species.

Therefore, it is important to find those strains that have a better performance in all probiotic requirements. In particular, immunological effects are considered to be rare among probiotics, and thus highly strain-10 specific [Hill et al. 2014], In view of the above, it is of great interest to find new therapies for subjects suffering from mild to moderate symptoms of COVID-19 in order to avoid progression to more severe disease.

SUMMARY OF THE INVENTION

Working examples herein provide detailed experimental data demonstrating significant positive effects in relation to the use of the probiotic compositions disclosed herein for the treatment of COVID-19 in a human patient.

Example 2 shows that the probiotic compositions disclosed herein significantly increase the rate of complete remission of the disease (at day 30 of intervention). Further, symptomatic remission is achieved earlier in patients receiving the probiotic composition. Particularly, the probiotic composition significantly reduces viral load in nasopharyngeal swabs during intervention, and is reduced 925 times on average (i.e., almost 1 log) at day 30 of intervention. Furthermore, the probiotic composition enhances the production of antibodies resulting in a significantly higher concentration of IgG and IgM. Finally, the duration of various specific symptoms of COVID-19 (e.g., fever, cough, headache, shortness of breath, bodily pain, hypoxemia and diarrhea) is significantly reduced in patients receiving the probiotic composition.

Example 3 shows on the one hand that serum concentration of interferon-beta was significantly increased in the probiotic group compared to placebo both after 15 days and 30 days of intervention. Type I interferons (interferon alpha and interferon beta) are proteins with the ability to restrict viral replication in vertebrate cells. Besides this direct antiviral effect, type-I interferons also have an 35 indirect antiviral effect, by means of stimulating B lymphocytes (B-cells) and Natural Killer lymphocytes (NK-cells). B-cells produce virus-specific antibodies that prevent viral spread by binding to viral particles.

Therefore, type-I interferons have a broad-spectrum antiviral activity. Accordingly, an impaired 40 type-I interferon response in humans is associated to a more severe disease upon lung infection by a variety of viruses, particularly coronaviruses such as SARS-CoV2, SARS-CoV1 (SARS) and MERS-CoV (MERS), but also influenza virus, human rhinovirus or respiratory syncytial virus, and even non-pulmonary viral infections like hepatitis C virus or brain infection (encephalitis) caused by herpes simplex virus [Channapannavar et al. 2019; Haagmans et al. 2004], Therefore, the skilled in the art will recognize the usefulness of the probiotic composition provided herein able to increase interferon-beta in patients to treat diseases where higher type-I interferons can be beneficial, particularly viral infections, particularly respiratory viral infections, more particularly lung viral infections.

On the other hand, Example 3 also shows that serum concentration of CXCL13 was significantly reduced over time in the probiotic group compared to placebo. CXCL13 is a protein which is induced by type-I interferons during viral infections and helps to start recruiting B-cells to infection sites. However, CXCL13 has a strong pro-inflammatory effect and is associated to lung damage across a wide spectrum of conditions, from COVID-19 to Lung Fibrosis and Chronic Obstructive Pulmonary Disease. Of note, blockade of CXCL13 has been shown to limit such lung damage.

Viral respiratory pathogens known to induce CXCL13 include SARS-COV2, influenza and respiratory syncytial virus. Therefore, inducing type-I interferons while limiting CXCL13 levels overtime can be useful in such viral infections to stimulate antiviral response while preventing lung tissue damage due to excessive inflammation, particularly infection by SARS-COV2, influenza virus or respiratory syncytial virus. This increase in type-I interferon while simultaneously decreasing CXCL13 is a surprising effect of the probiotic compositions provided herein, since CXCL13 is known to be induced by type-I interferons. Remarkably, this reduction in CXCL13 did not compromise the activity of B-cells, as shown by the increased levels of immunoglobulins IgG and IgM shown in Example 2. Further, these results correlate with a minor duration of the clinical symptoms and with viral clearance as shown in Example 3.

Example 4 shows that *L. plantarum* CECT 30292 significantly overexpresses Plantaricin G (plnG) gene in comparison to the strain type WCFS1 and also in comparison to all other tested strains. Plantaricin G is a bacterial surface protein found in some strains of the *Lactobacillus plantarum* species. This protein is specifically implicated in mechanisms to inhibit the growth of competing pathogens. Importantly, among proteins generally produced by *L. plantarum*, plnG is particularly recognized by Antigen-Presenting Cells (APCs), i.e., immune cells in charge of searching for potential pathogens. APCs release interferons and other immunoregulatory signals upon activation, thus helping activate other immune cells such as antibody-producing B-cells and natural killer (NK)-cells.

As discussed above with respect to the webpage disclosure in clinicaltrials.gov, the statements in this webpage disclosure may be seen as mere statements that are not supported by any significant verifiable experimental data—it is evident that based on this webpage disclosure it was not plausible/credible that herein relevant positive effects may be obtained in human patients.

Based on the knowledge of the prior art, the skilled person could not have foreseen with a reasonable expectation of success the herein experimentally described significant positive effects. Of note, the clinical results have exceeded the expectations beyond the initial study design hypothesis. Thus, the herein experimentally described significant positive effects are unexpected for the skilled person and may be considered as a great contribution to the art.

Accordingly, an aspect of the invention relates to a probiotic composition comprising: *Lactobacillus plantarum* strain deposited under the Budapest Treaty in the Spanish Type Culture Collection (CECT) under accession number CECT 30292, or a bacterial strain derived thereof, *Lactobacillus plantarum* strain deposited under the Budapest Treaty in CECT under accession number CECT 7484, or a bacterial strain derived thereof, *Lactobacillus plantarum* strain deposited under the Budapest Treaty in CECT under accession number CECT 7485, or a bacterial strain derived thereof, and *Pediococcus acidilactici* strain deposited under the Budapest Treaty in CECT under accession number CECT 7483 or a bacterial strain derived thereof, wherein each derived bacterial strain:

(a) has a genome at least 99.90% identical to the genome of the correspondent deposited strain; and (b) retains at least one ability of the correspondent deposited strain, the abilities being selected from the group consisting of:

to increase remission of COVID-19;

to reduce the duration of symptoms of COVID-19;

to reduce SARSCoV-2 viral load;

to stimulate antibodies production against SARSCoV-2 virus (i.e., to increase of antibody levels);

to improve blood oxygen saturation; and to reduce the duration of low oxygen saturation in blood (i.e., hypoxemia).

Another aspect relates to *Lactobacillus plantarum* strain deposited under the Budapest Treaty in the Spanish Type Culture Collection (CECT) under accession number CECT 30292, or a bacterial strain derived thereof, wherein the derived bacterial strain:

(a) has a genome at least 99.90% identical to the genome of the correspondent deposited strain; and (b) retains at least one ability of the correspondent deposited strain, the abilities being selected from the group consisting of:

to increase remission of COVID-19;

to reduce the duration of symptoms of COVID-19;

to reduce SARSCoV-2 viral load;

to stimulate antibodies production against SARSCoV-2 virus (i.e., to increase of antibody levels);

to improve blood oxygen saturation; and to reduce the duration of low oxygen saturation in blood (i.e., hypoxemia).

The invention also relates to a probiotic composition comprising *Lactobacillus plantarum* strain CECT 30292 or a bacterial strain derived thereof with the above-mentioned characteristics.

Another aspect relates to a probiotic composition comprising *Lactobacillus plantarum* strain deposited under the Budapest Treaty in the Spanish Type Culture Collection (CECT) under accession number CECT 30292, or a bacterial strain derived thereof, wherein the derived bacterial strain:

(a) has a genome at least 99.90% identical to the genome of the correspondent deposited strain; and (b) retains at least one ability of the correspondent deposited strain in comparison with a control, the abilities being selected from the group consisting of:

to stimulate IgG and IgM antibodies production against SARSCoV-2 virus; particularly IgG antibody levels are at least doubled;

to increase interferon-beta levels, particularly interferon-beta levels are at least 20% increased;

to reduce CXCL13 levels;

has at least the copy number of plnG gene of the deposited strain; and to overexpress plantaricin G, particularly plantaricin G is at least four-fold overexpressed.

Another aspect relates to *Lactobacillus plantarum* strain deposited under the Budapest Treaty in the Spanish Type Culture Collection (CECT) under accession number CECT 30292.

Another aspect relates to a method for obtaining a mutant strain of *Lactobacillus plantarum* strain deposited under CECT 30292, comprising the following steps:

(i): making mutants of *L. plantarum* CECT 30292;

(ii): analyzing the in step (i) obtained mutants and identifying a mutant strain that retains or improves at least one ability of the deposited strain; and (iii) isolating the in step (ii) identified mutant strain to thereby obtain the mutant strain of *L. plantarum* CECT 30292, wherein the mutant strain retains or improves at least one ability of the deposited strain.

"Probiotic composition" and "probiotic compositions" are used herein to refer to the different compositions according to the different aspects and embodiments of the present invention.

The probiotic compositions described herein can be used for different medical applications/uses which are described herein in detail. All the uses described herein can be alternatively formulated as the use of any of the compositions described herein for the manufacture of a pharmaceutical product, a veterinary product, a medicament, an edible product, a food supplement, or a dietary product, for the prevention and/or treatment of the diseases disclosed herein.

This may be also alternatively formulated as methods of treating or preventing the diseases described herein or symptoms and/or complications thereof in a subject in need thereof comprising administering to the subject the herein described probiotic compositions.

An aspect of the invention relates to the probiotic composition for use as a medicament (i.e., for use in the treatment or prevention of a disease). This aspect can alternatively be formulated as a method for probiotic treatment, comprising administering in a need thereof an effective amount of a probiotic composition of the present invention. The term "probiotic" as used herein, refers to live microorganisms that, when administered in adequate amounts, confer a health benefit on the host.

An aspect of the invention relates to the probiotic composition according to the invention, for use in a method of treating, preventing, or ameliorating COVID-19 or symptoms, complications and/or sequela thereof. This aspect can alternatively be formulated as a method of treating, preventing, or ameliorating COVID-19 or symptoms and/or complications thereof in a subject in need thereof comprising administering to the subject the probiotic composition described herein.

Another aspect relates to the probiotic composition according to the invention, for use in a method of treating, preventing, or ameliorating an infectious disease or symptoms, complications and/or sequela thereof. This aspect can alternatively be formulated as a method of treating, preventing, or ameliorating an infectious disease or symptoms and/or complications thereof in a subject in need thereof comprising administering to the subject the probiotic composition described herein.

Another aspect relates to the probiotic composition according to the invention, for use in enhancing immune response (i.e., for use in promoting, stimulating or boosting immune response or immunity). This aspect can alternatively be formulated as a method of enhancing immune response in a subject in need thereof comprising administering to the subject the probiotic composition described herein.

Another aspect relates to a dietary supplement comprising the probiotic composition described herein and at least one acceptable excipient.

Another aspect relates to a pharmaceutical composition comprising an effective amount the probiotic composition described herein and at least one pharmaceutically acceptable excipient.

Another aspect relates to an edible product comprising the probiotic composition described herein and at least one edible ingredient.

Terms used in the claims and aspects of the invention are understood in its widely and common meaning in this description. Nevertheless, some are defined hereinafter in the detailed description of the invention.

Throughout the description and claims the word "comprise" and its variations are not intended to exclude other technical features, additives, components, or steps. Additional objects, advantages and features of the invention will become apparent to those skilled in the art upon examination of the description or may be learned by practice of the invention. Furthermore, the present invention covers all possible combinations of particular and preferred embodiments described herein. The following examples and drawings are provided herein for illustrative purposes, and without intending to be limiting to the present invention.

DETAILED DESCRIPTION OF THE INVENTION

Definitions

Figure 1:
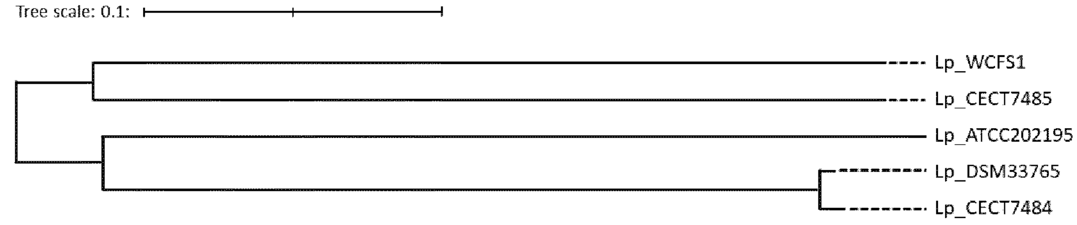
FIG. 1 shows a tree analysis based on ANI (Average Nucleotide Identity) where the train of *L. plantarum* DSM 33765 belongs to the same clade as CECT 7484 (ANI of 99.71%), while being more distantly related to reference strain WCFS1, as well as ATCC 202195 and CECT 7485 (ANI values of 98.7-98.8%). See working Example herein for further details.
Figure 2:
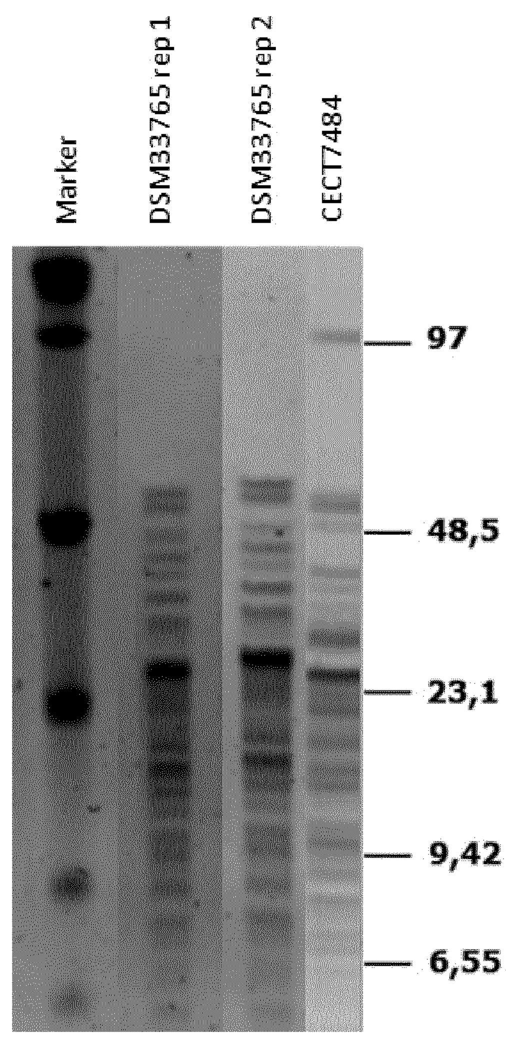
FIG. 2 shows a Pulse-field gel electrophoresis (PFGE), showing that the *L. plantarum* DSM 33765 strain (two replicated rep1 and rep2) has a reproducible PFGE profile, which is different than the profile of closely related strain *L. plantarum* CECT 7484. Particularly, compared to CECT 7484, strain DSM 33765 lacks a band of 97 kDa but has additional bands between 48.5 and 32.1 kDa. Hence, albeit closely related, both strains are demonstrated to be different one another. See working Example herein for further details.

Derived from: The terms "derived from," "derivative", "variant", "mutant" (e.g., "mutant strain"), or any grammatical variant thereof, as used herein, refer to a component that is isolated from or made using a specified molecule/substance (e.g., a strain of the present disclosure). For example, a bacterial strain that is derived from a first bacterial strain (e.g., a deposited strain) can be a strain that is identical or substantially similar to the first strain. In the case of bacterial strains, the derived strain can be obtained by, for example, naturally occurring mutagenesis, artificially-directed mutagenesis or artificially random mutagenesis.

Excipient: The terms "excipient" and "carrier" are used interchangeably and refer to an inert substance added to a e.g., pharmaceutical composition to further facilitate administration of a compound, e.g., a bacterial strain of the present disclosure.

Identity: As used herein, the term "identity" refers to the overall conservation of the monomeric sequence between polymeric molecules, e.g., between DNA molecules and/or RNA molecules. The term "identical" without any additional qualifiers, implies the sequences are 100% identical (100% sequence identity). Describing two sequences as, e.g., "70% identical," is equivalent to describing them as having, e.g., "70% sequence identity."

Calculation of the percent identity of two polymeric molecules, e.g., polynucleotide sequences, can be performed, e.g., by aligning the two sequences for optimal comparison purposes (e.g., gaps can be introduced in one or both of a first and a second polynucleotide sequences for optimal alignment). In certain aspects, the length of a sequence aligned for comparison purposes is at least about 30%, at least about 40%, at least about 50%, at least about 60%, at least about 70%, at least about 80%, at least about 90% or about 100% of the length of the reference sequence. The bases at corresponding base positions, in the case of polynucleotides, are then compared.

The percent identity between the two sequences is a function of the number of identical positions shared by the sequences, taking into account the number of gaps, and the length of each gap, which can be determined using a mathematical algorithm. Suitable software programs are available for alignment of both protein and nucleotide sequences. One suitable program to determine percent sequence identity is bl2seq, which performs a comparison between two sequences using either the BLASTN (used to compare nucleic acid sequences) or BLASTP (used to compare amino acid sequences) algorithm. Other suitable programs are, e.g., Needle, Stretcher, Water, or Matcher, part of the EMBOSS suite of bioinformatics programs. Sequence alignments can be conducted using methods known in the art such as MAFFT, Clustal (ClustalW, Clustal X or Clustal Omega), MUSCLE, MAUVE, MUMMER, RAST, etc.

In certain aspects, the percentage identity (% ID) of a first sequence to a second sequence is calculated as % ID=100×(Y/Z), where Y is the number of amino acid residues or nucleobases scored as identical matches in the alignment of the first and second sequences (e.g., as aligned by visual inspection or a particular sequence alignment program) and Z is the total number of residues in the second sequence. When comparing complete or near complete genomic nucleobase sequences, % ID is sometimes referred to as ANI (Average Nucleotide Identity).

Prevent: The terms "prevent," "preventing," "prophylaxis" and variants thereof as used herein, refer, e.g., to (i) partially or completely delaying onset of a disease, disorder and/or condition disclosed herein;
(ii) partially or completely delaying onset of one or more symptoms, features, or clinical manifestations, complications, or sequelae of a particular disease, disorder, and/or condition disclosed herein;
(iii) partially or completely delaying onset of one or more symptoms, features, or manifestations, complications, or sequelae of a particular disease, disorder, and/or condition disclosed herein;
(iv) partially or completely delaying progression from a particular disease, disorder and/or condition disclosed herein; and/or
(v) decreasing the risk of developing pathology associated with the disease, disorder, and/or condition disclosed herein.

Subject: The terms "subject," "patient," "individual," and "host," and variants thereof are used interchangeably herein and refer to any mammalian subject, particularly humans, but also including without limitation, humans, domestic animals (e.g., dogs, cats and the like), farm animals (e.g., cows, sheep, pigs, horses and the like), and laboratory animals (e.g., monkey, rats, mice, rabbits, guinea pigs and the like) for whom diagnosis, treatment, or therapy is desired. The methods described herein are applicable to both human therapy and veterinary applications.

Subject in need thereof: As used herein, "subject in need thereof includes subjects, such as mammalian subjects, that would benefit from administration of the compositions of the disclosure.

Therapeutically effective amount: As used herein the term "therapeutically effective amount" is the amount of a composition of the present disclosure that is sufficient to a produce a desired therapeutic effect, pharmacologic and/or physiologic effect on a subject in need thereof.

Treatment: The terms "treat," "treatment," "therapy," as used herein refer to, e.g., the reduction in severity of disease or condition disclosed herein; the amelioration or elimination of one or more symptoms, complication, or sequelae associated with a disease disclosed herein (e.g., a coronavirus disease such as COVID-19); the provision of beneficial effects to a subject with a condition/disease disclosed herein, without necessarily curing the disease or condition. The term also includes prophylaxis or prevention of a disease or condition or symptoms, complications, or sequelae thereof.

The term refers to a clinical or nutritional intervention to prevent the disease or condition; cure the disease or condition; delay onset of the disease or condition; delay onset of a symptom, complication or sequela; reduce the seriousness of the disease or condition; reduce the seriousness of a symptom, complication, or sequela; improve one or more symptoms; improve one or more complications; improve one or more sequelae; prevent one or more symptoms; prevent one or more complications; prevent one or more sequelae; delay one or more symptoms; delay one or more symptoms; delay one or more complications; delay one or more sequelae; ameliorate one or more symptoms; ameliorate one or more complications; ameliorate one or more sequelae; shorten the duration one or more symptoms; shorten the duration one or more complications; shorten the duration of one or more sequelae; reduce the frequency of one or more symptoms; reduce the frequency of one or more complications; reduce the frequency of one or more sequelae; reduce the severity of one or more symptoms; reduce the severity of one or more complications; reduce the severity of one or more sequelae; improve the quality of life; increase survival; prevent a recurrence of the disease or condition; delay a recurrence of the disease or condition; or any combination thereof, e.g., with respect to what is expected in the absence of the treatment with the composition of the present disclosure.

Symptom: As used herein, the term "symptom" refers to subjective or physical sign, indication, or evidence of disease or physical disturbance observed by the subject. In general, the term refers to any morbid phenomenon or departure from the normal in structure, function, or sensation, experienced by the patient and indicative of disease. Symptoms are felt or noticed by the individual experiencing the symptom but may not easily be noticed by others. In some aspects, a symptom can be a mild symptom, a moderate symptom, or severe symptom. As used herein, the term "mild symptom" refers to a symptom that is not life threatening and does not require, e.g., intensive care treatment (e.g., at a hospital ICU). As used herein, the term "moderate symptom" refers to a symptom that requires monitoring because it may become life threatening and may require, e.g., hospitalization. As used herein, the term "severe symptom" refers to a symptom that is life threatening and requires, e.g., intensive care treatment (e.g., at a hospital ICU).

Complication: As used herein, the term "complication" refers to a pathological process or event occurring during a disease or condition that is not an essential part of the disease or condition, where it may result from the disease/condition or from independent causes. Accordingly, the term complication refers to medical/clinical problems that are observed in subjects diagnosed with a disease or conditions disclosed herein, e.g., COVID-19. In some aspects, a complication can be temporary.

In some aspects, a complication can be chronic or permanent. As used herein, the term "sequela" refers to a long term, chronic, or permanent complication.

Probiotic Composition

As previously discussed, an aspect of the invention relates to a probiotic composition comprising *Lactobacillus plantarum* strain deposited under accession number CECT 30292, or a bacterial strain derived thereof.

In an embodiment, the *Lactobacillus plantarum* strain is the strain deposited under accession number CECT 30292.

In one embodiment, the probiotic composition further comprises, *Lactobacillus plantarum* CECT 7484, *Lactobacillus plantarum* CECT 7485, and *Pediococcus acidilactici* CECT 7483.

*Lactobacillus plantarum* CECT 30292 (also referred in this description as DSM 33765) was isolated from humans (fecal sample) and chicory (*Cichorium intybus*). The strain was deposited in the German Collection of Microorganisms and Cell Cultures GmbH (DSMZ) with address Leibniz-Institut DSMZ-Deutsche Sammlung von Mikroogranismen und ZellKulturen GmbH, Inhoffenstr, 7B D-38124 Braunschweig, Germany) The deposited strain received the accession number DSM 33765 and deposit date Jan. 27, 2021 (27.01.2021). The strain was also deposited in the Spanish Type Culture Collection (CECT, Parc Cientific de la Universitat de Valencia, Carrer del Catedratic Agustin Escardino Benlloch, 9, 46980 Paterna, Valencia, Spain) on Jan. 26, 2021 (26.01.2021) with accession number CECT 30292. Both deposits were performed under the conditions of the Budapest Treaty, are viable and keep all their features related to their deposit. They were deposited by the same applicant.

A particular embodiment is related to a *Lactobacillus plantarum* strain deposited under the Budapest Treaty in the Spanish Type Culture Collection (CECT) under accession number CECT 30292. The invention also relates to a probiotic composition comprising the *Lactobacillus plantarum* strain CECT 30292.

Strains *Lactobacillus plantarum* strains CECT 7485 and CECT 7484 and *Pediococcus acidilactici* strain CECT 7483 are described and protected in WO2011092261A1, whose content is incorporated herein by reference in its entirety. These three strains were deposited in the Spanish Type Culture Collection (Parc Cientific de la Universitat de Valencia, Carrer del Catedratic Agustin Escardino Benlloch, 9, 46980 Paterna, Valencia, Spain) on Feb. 4, 2009 (04.02.2009) by the same applicant of the present application.

As understood by the skilled person in the present context, a bacterial strain has been isolated from its natural environment, i.e., it is not present in its natural environment, so it is free from other organisms and substances present in the natural environment.

*Lactoplantibacillus plantarum* (*L. plantarum*) was previously known as *Lactobacillus plantarum*—thus, *Lactoplan-*

*tibacillus plantarum* and *Lactobacillus plantarum* are used indistinctly in this description.

A wide variety of lactic acid bacterial species have a long history of apparent safe use. The European Food Safety Authority has developed a system granting the "Qualified Presumption of Safety" (QPS) status to taxonomical units with a proven long history of apparent safe use. Strains *P. acidi-lactici* CECT 7483, *L. plantarum* CECT 7484 and *L. plantarum* CECT 7485 and *L. plantarum* DSM 33765 belong to bacterial species that have QPS status.

The emergence and spread of resistance to antimicrobials in bacteria pose a threat to human and animal health and present a major financial and societal cost. It has been found by whole genome sequence analysis that novel strain *L. plantarum* DSM 33765 does not possess antibiotic resistance genes. Strains CECT 7483, CECT 7484 and CECT 7485 do not possess antibiotic resistances either. Overall, these results preclude the risk of a potential transfer of antibiotic resistance to pathogenic species.

It is clear that by using the deposited strains as starting material, the skilled person in the art can routinely, by conventional mutagenesis or re-isolation techniques (i.e., reculturing), obtain further variants or mutants thereof that retain or enhance the herein described relevant features and advantages of the strains forming the composition of the invention. Thus, the invention also relates to variants of strains disclosed herein. As used herein, the term "variant" or "mutant" of a strain refers to any naturally-occurring or specifically developed strain obtained from the deposited reference strain, mainly by mutation, that retains at least one ability mentioned above of the deposited strain.

Example 5 shows the variability between the genomes of two different batches of the same strain (DSM 33765). It is proved that two isolates of the same strain can differ by 0.01% of average nucleotide identity (ANI). Therefore, a strain displaying 99.99% ANI to the genome of the correspondent deposited strain is considered the same deposited strain CECT 30292.

In a particular embodiment, the bacterial strain derived from the deposited strain has a genome at least 99.90% identical to the genome of the correspondent deposited strain; more particularly, % of identity is 99.91%, 99.92%, 99.93%, 99.94%, 99.95%, 99.96%, 99.97%, 99.98%, or 99.99%. Particularly the % of identity is at least 99.95%. In a particular embodiment, the mutants are obtained by using recombinant DNA technology. In another embodiment, the mutants are obtained by random mutagenesis. In another embodiment, the mutant is a naturally occurring variant. In another embodiment, the mutant is obtained by reculturing the deposited strain. Thus, another aspect of the invention relates to a method to obtain a strain derived from the deposited strain (in particular, *L. plantarum* CECT 30292), wherein the method comprises using the deposited strain as starting material and applying mutagenesis or reculturing, and wherein the obtained variant or mutant further retains or enhances at least one ability of the deposited strain.

This can alternatively be expressed as a method for obtaining a mutant strain of a deposited strain (in particular *L. plantarum* CECT 30292) comprising the following steps:

(i): making mutants of *L. plantarum* CECT 30292;

(ii): analyzing the in step (i) obtained mutants and identifying a mutant strain that retains or improves at least one ability of the deposited strain; and (111) isolating the in step (ii) identified mutant strain to thereby obtain the mutant strain of *L. plantarum* CECT 30292, wherein the mutant strain retains or improves at least one ability of the deposited strain.

In some embodiments, the obtained mutant retains (or improves) at least one ability of the correspondent deposited strain in comparison with a control, the abilities being selected from the group consisting of:

to increase remission of COVID-19;

to reduce the duration of symptoms of COVID-19;

to reduce SARSCoV-2 viral load;

to stimulate antibodies production against SARSCoV-2 virus; in particular to stimulate IgG and IgM antibodies production against SARSCoV-2 virus; more particularly IgG antibody levels are at least doubled;

to improve hypoxemia;

to reduce the duration of hypoxemia;

to increase interferon-beta levels, particularly interferon-beta levels are at least 20% increased;

to reduce CXCL13 levels;

has at least the copy number of plnG gene or more copies of the gene of the deposited strain; and to overexpress plantaricin G, particularly plantaricin G is at least four-fold overexpressed.

The control is understood as a placebo or a control strain which does not have such particular ability.

In a particular embodiment, the obtained mutant retains (or improves) at least one ability of the correspondent deposited strain, wherein the ability is selected from the group consisting of: to increase remission of COVID-19; to reduce the duration of symptoms of COVID-19; to reduce SARSCoV-2 viral load; to stimulate antibodies production against SARSCoV-2 virus; in particular to stimulate IgG and IgM antibodies production against SARSCoV-2 virus; more particularly IgG antibody levels are at least doubled; to improve hypoxemia; and to reduce the duration of hypoxemia. In a particular embodiment, the control for such abilities is a placebo.

In a particular embodiment, the obtained mutant retains (or improves) at least one ability of the correspondent deposited strain, wherein the ability is to stimulate antibodies production against SARSCoV-2 virus; in particular, to stimulate IgG and IgM antibodies production against SARSCoV-2 virus; more particularly IgG antibody levels are at least doubled. In a particular embodiment, the control for such ability is a placebo.

In a particular embodiment, the obtained mutant retains (or improves) at least one ability of the correspondent deposited strain, wherein the ability is to increase interferon-beta levels, particularly interferon-beta levels are at least 20% increased. In a particular embodiment, the control for such ability is a placebo.

In a particular embodiment, the obtained mutant retains (or improves) at least one ability of the correspondent deposited strain, wherein the ability is to reduce CXCL13 levels. In a particular embodiment, the control for such ability is a placebo.

In a particular embodiment, the obtained mutant retains (or improves) at least one ability of the correspondent deposited strain, wherein the ability is that has at least the copy number of plnG gene or more copies of the gene of the deposited strain. In a particular embodiment, the control for such ability is a strain which only has one copy of plnG gene, such as e.g., WCSF1 strain.

In a particular embodiment, the obtained mutant retains (or improves) at least one ability of the correspondent deposited strain, wherein the ability is to overexpress plantaricin G, particularly plantaricin G is at least four-fold overexpressed. In a particular embodiment, the control for such ability is e.g., WCSF1 strain.

The skilled person in the art will decide upon the adequate method to be employed for determining the abilities of the obtained mutant in respect of the correspondent deposited strain. Examples of possible methods to measure these abilities are shown in the Examples section.

Example 6 shows that the strain CECT 30292 has additional copies of the plnG gene in plasmids. Thus, a skilled in the art can attempt to increase the number of copies of plasmids containing the plnG gene, or to insert additional copies of the plnG gene into the bacterial DNA of the deposited strains. Therefore, in an embodiment, the bacterial strain derived thereof has been obtained derived from the deposited strain by insertion of additional copies of the plnG gene, either in the bacterial chromosome or in plasmids.

It is evident that it is routine work for the skilled person to obtain a mutant strain of CECT 30292 even without the knowledge of the genome sequence.

The strains forming part of the composition of the invention may be in the form of viable cells. Alternatively, the strain may be in the form of non-viable cells. This could include thermally killed micro-organisms or micro-organisms killed by exposure to altered pH, sonication, radiation or high pressure. Product preparation is simpler with non-viable cells, as cells may be incorporated easily into dietary, pharmaceuticals or edible products, and storage requirements are much less limited than viable cells.

The strains disclosed herein are produced by cultivating (or fermenting) the bacteria in a suitable artificial medium and under suitable conditions. By the expression, "artificial medium" for microorganisms is understood to be a medium containing natural substances, and optionally synthetic chemicals such as the polymer polyvinyl alcohol which can reproduce some of the functions of serums. Common suitable artificial media are nutrient broths that contain the elements including a carbon source (e.g., glucose), a nitrogen source (e.g., amino acids and proteins), water and salts needed for bacterial growth. Growth media can be liquid form or often mixed with agar or another gelling agent to obtain a solid medium. The strains can be cultivated alone to form a pure culture, or as a mixed culture together with other microorganisms, or by cultivating bacteria of different types separately and then combining them in the desired proportions. After cultivation, and depending on the final formulation, the strains may be used as purified bacteria, or alternatively, the bacterial culture or the cell suspension may be used, either as such or after an appropriate posttreatment. In this description, the term "biomass" is understood to be the bacterial strains culture obtained after cultivation (or fermentation as a term synonymous to cultivation).

In a particular embodiment, the strains are fermented in an artificial medium and submitted to a post-treatment after the fermentation, to obtain bacterial cells, and the resulting bacterial cells are in a liquid medium or in a solid form. Particularly, the post-treatment is selected from the group consisting of: drying, freezing, freeze-drying, fluid bed-drying, spray-drying and refrigerating in liquid medium, and more particularly, is freeze-drying.

By the term "post-treatment" is to be understood in the present context, any processing carried out on the biomass with the aim of obtaining storable bacterial cells. The objective of the posttreatment is decreasing the metabolic activity of the cells in the biomass, and thus, slowing the rate of cellular deleterious reactions. As a result of the post-treatment, the bacterial cells can be in solid or liquid form. In solid form, the stored bacterial cells can be a powder or granules. In any case, both the solid and liquid forms containing the bacterial cells are not present in nature, hence, are not naturally-occurring, since they are the result of artificial post-treatment process(es). The post-treatment processes may in particular embodiments require the use of one or more of so-called post-treatment agents. In the context of the present invention, the expression "post-treatment agent" refers to a compound used to perform the herein described post-treatment processes. Among the post-treatment agents are to be included, without limitation, dehydrating agents, bacteriostatic agents, cryoprotective agents (cryoprotectants), inert fillers (also known as lyoprotectants), carrier material (also known as core material), etc., used either alone or in combination.

There are two basic approaches to decrease the metabolic activity of the bacterial cells, and thus, two approaches to carry out the post-treatment. The first one is decreasing the rate of all chemical reactions, which can be done by lowering the temperature by refrigerating or freezing using refrigerators, mechanical freezers, and liquid nitrogen freezers. Alternatively, decreasing the rate of all chemical reactions can be achieved by adding substances that inhibit the growth of the bacterial cells, namely a bacteriostatic agent, abbreviated Bstatic.

The second approach to carry out the post-treatment is to remove water from the biomass, a process which can involve sublimation of water using a lyophilizer. Suitable techniques to remove water from the biomass are drying, freeze-drying, spray-drying or fluid bed-drying. Post-treatments that result in solid form may be drying, freezing, freeze-drying, fluid bed-drying, or spray-drying.

The post-treatment is particularly freeze-drying, which involves the removal of water from frozen bacterial suspensions by sublimation under reduced pressure. This process consists of three steps: pre-freezing the product to form a frozen structure, primary drying to remove most water, and secondary drying to remove bound water. Due to objective and expected variability of industrial processes for manufacturing and isolation of lyophilized bacterial cultures, the latter commonly contain a certain amount of inert filler also known as lyoprotectant. Its role is to standardize the content of live probiotic bacteria in the product. The following inert fillers in commercially available lyophilized cultures are used: sucrose, saccharose, lactose, trehalose, glucose, maltose, maltodextrin, corn starch, inulin, and other pharmaceutically acceptable non-hygroscopic fillers. Optionally, other stabilizing or freeze-protecting agents like ascorbic acid, are also used to form a viscous paste, which is submitted to freeze-drying. In any case, the so-obtained material can be grinded to appropriate size, including to a powder.

Alternatively to having biomass preserved in solid form, biomass may be also preserved in liquid form. This may be done by adding a bacteriostatic agent as described above to stop bacteria growth to the culture medium or with an intermediate step of harvesting cells, re-suspending the pellet in saline solution with a bacteriostatic agent, and optionally refrigerating it.

Sometimes, as described for instance above in the fluid bed-drying process, the probiotic preparation is subjected to an immobilization and/or coating, or encapsulation process in order to improve the shelf life and/or functionalities. Several techniques for immobilization, coating or encapsulation of bacteria are known in the art.

The effective amount of colony forming units (cfu) for each strain in the composition will be determined by the skilled in the art and will depend upon the final formulation. The term "colony forming unit" ("cfu") is defined as the number of bacterial cells as revealed by microbiological counts on agar plates.

In some embodiments, e.g., in edible products (e.g., yogurts, candies), the strain(s) are present in an amount from $10^5$ cfu/g to $10^{12}$ cfu/g, more particularly from $10^7$ cfu/g to $10^{11}$ cfu/g. In some embodiments, e.g., in dietary supplements (e.g., a tablet), the strain(s) are present in an amount ranging from $10^6$ and $10^{12}$ cfu per dose (e.g., a tablet), and particularly from $10^8$ and $10^{11}$ cfu per dose.

In a particular embodiment, the probiotic composition is comprised by 50% of the strain *L. plantarum* CECT 30292 (e.g., 1 billion cfu), and 50% of a mixture of *L. plantarum* CECT 7485, CECT 7484, and *P. acidilactici* CECT 7483 (e.g., the mixture having an equivalent proportion of the three strains and a total of 1 billion cfu).

As known by the skilled person, the effective amount of colony units can also be measured by the effective amount of active fluorescent units (afu). The term "active fluorescent unit" ("afu") is defined as the number of bacterial cells as revealed by flow cytometry counts in a gate specific for fluorescence characteristics of presumed live cells. Therefore, the skilled person would consider the above-mentioned specific quantities of colony forming units (cfu) to be about the same quantity of active fluorescence units (afu).

In one embodiment, the probiotic composition is a solid composition.

In another embodiment, the probiotic composition is a solid composition comprising: a freeze-dried bacterial biomass comprising from about $10^5$ cfu to about $10^{12}$ cfu of each strain; and a cryoprotectant.

Particularly, the probiotic composition comprises at least one cryoprotectant that is an allergen-free cryoprotectant.

In some embodiments, the probiotic composition comprises at least one cryoprotectant selected from the group consisting of: maltose, trehalose, mannitol (particularly, d-mannitol), saccharose, lectose, dextrose, sodium ascorbate or sodium citrate.

More particularly, the composition further comprises a pharmaceutically acceptable carrier chosen from an emulsion, a suspension, a gel, a paste, granules, a powder, and a gum. Particularly, the carrier is an allergen-free carrier.

In some embodiments, the probiotic composition comprises one or more carriers selected from the group consisting of: maltodextrin, cellulose, starches of various types, inulin, lactose, or carrier with 5 reduced water activity.

Medical Uses of the Probiotic Composition—Method of Treating, Preventing, or Ameliorating COVID-19 or Symptoms, Complications and/or Sequela Thereof In some embodiments, the administration of the probiotic composition results in the treatment, prevention or amelioration at least one symptom of COVID-19 selected from the group consisting of:—fever;

cough, particularly dry cough;
headache;
shortness of breath;
bodily pain, particularly muscle pain;
low oxygen saturation (hypoxemia) in blood, particularly an oxygen saturation SaO2 or SpO2<92%; and
diarrhea.

As known by the skilled person, SaO2 is an alternative measure of oxygen saturation in blood, that refers to oxygen saturation measured in arteries and the later to oxygen saturation measured by pulse oximetry. SaO2 measures equivalent to SpO2 measures can be used indistinctly in this description.

In some embodiments, the administration of the probiotic composition results in at least one outcome (i.e., effect) selected from the group consisting of:

remission of COVID-19;
reduction of the duration of symptoms of COVID-19;
reduction of SARS-CoV-2 viral load;
stimulation of antibodies production against SARS-CoV-2 virus (i.e., increase of antibody levels); particularly stimulation of IgG and IgM antibodies production against SARSCoV-2 virus; more particularly IgG antibody levels are at least doubled;
improvement of blood oxygen saturation (hypoxemia); and
reduction of the duration of low oxygen saturation in blood (i.e., hypoxemia).

In some embodiments, the administration of the probiotic composition results in at least one outcome (i.e., effect) selected from the group consisting of:

increase of interferon-beta levels, particularly interferon-beta levels are 20% increased; and
reduction of CXCL13 levels.

In some embodiments, the administration of the probiotic composition to the subject can avoid hospitalization or reduce hospitalization time, avoid ICU admission (i.e., eliminate the need for ICU treatment), delay the need for ICU treatment, reduce (shorten) ICU treatment time, reduce patient mortality rate, increase patient survival rate, reduce patient's chance of death, increase patient's chance of survival, decrease patient's risk of death, reduce the severity of at least one symptom, reduce the severity of at least one complication, reduce the severity of at least one sequela, reduce the duration of at least one symptom, reduce the duration of at least one complication, reduce the duration of at least one sequela, or any combination thereof. Accordingly, the present disclosure provides methods to avoid or reduce hospitalization, reduce (shorten) ICU treatment time, delay the need for ICU treatment, avoid ICU admission (i.e., eliminate the need for ICU treatment), reduce patient mortality rate, increase patient survival rate, reduce patient's chance of death, increase patient's chance of survival, decrease patient's risk of death, reduce the severity of at least one symptom, reduce the severity of at least one complication, reduce the severity of at least one sequela, reduce the duration of at least one symptom, reduce the duration of at least one complication, reduce the duration of at least one sequela, or any combination thereof, in a subject and comprises administering the probiotic composition to the subject.

Medical Uses of the Probiotic Composition—Method of Treating, Preventing, or Ameliorating an Infectious Disease or Symptoms, Complications and/or Sequela Thereof.

As discussed herein, the probiotic composition presents a high efficacy in inducing remission of COVID-19 patients, as well as shortening duration of symptoms (e.g., shortness of breath, hypoxemia, diarrhea) and increasing virus-specific antibodies. Moreover, the composition has shown a significant beneficial effect in reducing the duration of low oxygen saturation in blood (hypoxemia).

Accordingly, the experimental data herein provides evidence that it is plausible that the probiotic composition would have significant positive effects in other infectious diseases. Particularly, the probiotic composition would have significant positive effects in other infectious diseases characterized in presenting one or more of the above mentioned respiratory and/or gastrointestinal symptoms.

In particular, the experimental data herein provides evidence that it is plausible that the probiotic composition would have significant positive effects in treating other viral respiratory infections with shortness of breath and hypoxemia (particularly SpO2 below 92%), e.g., SARS, MERS, human adenovirus 55, influenza of type A, particularly H1N1, or novel emerging viruses.

Particularly, hypoxemia occurs in a respiratory infectious disease related to viral bronchiolitis infections of the lungs in infants and children. Viral bronchiolitis is most typically caused by Respiratory Syncytial Virus, but can also be caused by rhinovirus, adenovirus, pneumovirus, human bocavirus, influenza virus or parainfluenza virus. Simultaneous bronchiolitis by more than one virus in the same individual is often reported. Hypoxemia has also been identified as a risk factor for death from viral influenza. The probiotic composition described herein presents a high efficacy in reducing symptoms related to respiratory tract infections. In particular, the experimental data herein provides evidence that it is plausible that the probiotic composition would have significant positive effects in treating other respiratory infections (e.g., viral) producing shortness of breath or hypoxemia (particularly SaO2 or SpO2<92%), e.g., severe influenza or viral bronchiolitis. Particularly, the experimental data herein provides evidence that it is plausible that the probiotic composition would have significant positive effects in treating low oxygen saturation in blood (particularly SpO2 below 92%).

Accordingly, in some embodiments, the infectious disease is caused by a bacterial, a viral, a parasitic and/or a fungal infection.

In a particular embodiment, the infectious disease is caused by a viral infection. More particularly, the viral infection is selected from the group consisting of adenovirus, viral hepatitis (particularly hepatitis C virus), viral encephalitis (particularly herpes simplex encephalitis), human bocavirus, human rhinovirus, influenza virus, particularly influenza virus of type A (particularly H1N1 and its variants), parainfluenza virus, pneumovirus, coronavirus, particularly beta-coronaviruses (more particularly SARS-CoV1, SARS-CoV2 or MERS-CoV), respiratory syncytial virus, rhinovirus and novel or emerging viruses. More particularly, the viral infection is a coronavirus, influenza or respiratory syncytial viral infection.

In a particular embodiment, the viral infection is a coronavirus infection. Coronaviruses are large, enveloped, single-stranded RNA viruses found in humans and other mammals. Coronaviruses (CoV) induce acute and chronic diseases. Coronaviruses cause respiratory, gastrointestinal, and neurological disease. There are 7 known coronaviruses to cause disease in humans: On the one hand, 229E, OC43, NL63, and HKU1 typically produce common cold symptoms not easily separable from symptoms caused by other respiratory viruses, and with no shortness of breath and no complications in immunocompromised individuals. Thus, in some embodiments, the coronavirus is e.g., 229E, OC43, NL63, and HKU1 or mutants thereof.

On the other hand, SARS-CoV-1, MERS-CoV and SARS-CoV-2 (all three belonging to the betacoronavirus subgroup) can produce more severe disease, ranging from dyspnea (shortness of breath) and low blood oxygen saturation (hypoxemia) to death. In particular, SARS-CoV-2 is the third coronavirus that has caused severe disease in humans to spread globally in the past 2 decades. These three types of CoV are CoV-associated severe acute respiratory syndrome (SARS-CoV-1 and SARS-CoV-2) and the Middle East respiratory syndrome associated with CoV (MERS-CoV).

In a particular embodiment, the coronavirus is a beta-coronavirus.

In a particular embodiment, the coronavirus is SARS-CoV-2 virus, SARS-CoV-1 virus, or MERS-CoV virus.

In some embodiments, the viral infection is caused by the SARS (Severe Acute Respiratory Syndrome) virus or SARS-CoV-1, a virus identified in 2003. SARS was first reported in Asia in February 2003. The illness spread to more than two dozen countries in North America, South America, Europe, and Asia before the SARS global outbreak of 2003 was contained. Since 2004, there have not been any known cases of SARS reported anywhere in the world. In some aspects, the coronavirus infection is caused by the MERS (Middle East Respiratory Syndrome) virus or MERS-CoV. MERS is viral respiratory illness that is new to humans. It was first reported in Saudi Arabia in 2012 and has since spread to several other countries, including the United States. Most people infected with MERS-CoV developed severe respiratory illness, including fever, cough, and shortness of breath.

In some embodiments, the viral infection is caused by SARS-CoV-2. As used herein, the terms "SARS-CoV-2," "SARS-CoV-2 virus," and "COVID-19 virus" are used interchangeably to refer to the coronavirus causing COVID-19 (coronavirus disease 2019). As used herein, the term "COVID-19" refers to the viral infection caused SARS-CoV-2. COVID-19 is a new infectious disease caused by the severe acute respiratory syndrome 2 coronavirus (SARS-CoV-2). COVID-19 disease was described for first time on Dec. 1, 2019 and became pandemic in few weeks. Studies demonstrate that SARS-CoV-2 induces a cytokine storm that is associated with the severity of COVID-19 disease and its prognosis. COVID-19 patients can develop mild symptoms (local symptoms in the upper respiratory tract with fever, muscle pain, etc.), moderate (mild pneumonia) or severe, including severe pneumonia, acute respiratory distress syndrome (ARDS), sepsis and septic shock. Nevertheless, although most individuals infected with SARS-CoV-2 may not have any illness or can develop mild illness, SARS-CoV-2 infection is not simply a common cold.

In some embodiments, the viral infection can be caused by other viruses such as e.g.: human adenovirus 55, influenza virus (e.g., influenza of type A, particularly H1N1) or Respiratory syncytial Virus.

In one embodiment, the infectious disease results in (or induces) a respiratory disease.

In a particular embodiment, the respiratory disease is characterized by shortness of breath.

In a particular embodiment, the respiratory disease is characterized by hypoxemia (particularly SaO2 or SpO2 below 92%).

In a particular embodiment, the respiratory disease affects the upper respiratory tract.

In a particular embodiment, the respiratory disease affects the lower respiratory tract (i.e., lung, alveoli).

In a particular embodiment, the respiratory disease is pneumonia, particularly mild or severe pneumonia.

In a particular embodiment, the respiratory disease is ARDS.

As used herein the terms "Acute Respiratory Distress Syndrome" and "ARDS" refers to a disease or condition of the lungs in which an infection (e.g., a viral infection) or trauma to the lungs leads to inflammation of the lungs, accumulation of fluid in the alveolar air sacs, low blood oxygen, and respiratory distress. Accordingly, in some embodiments, the present disclosure provides a method to treat ARDS comprising administering a probiotic composition of the present disclosure.

ARDS is a life-threatening condition, and severe injury occurs to most or all of both lungs. ARDS is a rapid onset of progressive malfunction of the lungs, especially with regard to the ability to take in oxygen, usually associated with the malfunction of other organs. ARDS is characterized by diffuse pulmonary microvascular injury resulting in increased permeability and, thus, non-cardiogenic pulmonary edema. The basic abnormality in ARDS is the disruption of the normal alveolar-capillary barrier. Alternative terms frequently used to refer to ARDS include adult hyaline-membrane disease, adult respiratory insufficiency syndrome, congestive atelectasis, hemorrhagic lung syndrome, Da Nang lung, stiff-lung syndrome, shock lung, white lung and wet lung, among others.

In some embodiments, a patient is considered to suffer from "ARDS" if the following symptoms are present:

1) Clinical evidence of respiratory distress.
2) Chest radiograph revealing diffuse bilateral airspace disease ("pulmonary edema").
3) Hypoxemia that is difficult to correct with oxygen supplementation.
4) Hemodynamic evidence of a pulmonary artery occlusion (wedge) pressure <18 mm Hg.
5) Thoracic static compliance less than 40 mL/cm of water.

In some embodiments, the cause of ARDS is, e.g., severe, widespread infection (sepsis); severe low blood pressure (shock); pneumonia; aspiration (inhalation) of food into the lung; injury to the lungs from breathing high concentrations of oxygen; pulmonary embolism; chest injury; burns; overdose of a drug; or disseminated intravascular coagulation.

In some embodiments, sequelae resulting from lung edema in ARDS patients include a decrease in lung volumes, compliance, and large intrapulmonary shunts (blood perfusing unventilated seg-merits of the lung). The decrease in lung volume (residual volume) contributes to ventilation/perfusion inequality. The decrease in lung compliance is caused by the increased lung recoil pressure of the edematous lung, which clinically increases the work of breathing and leads to respiratory muscle fatigue. ARDS affects pulmonary vasculature. Pulmonary hypertension not related to hypoxemia is very common in patients with ARDS. Pulmonary hypertension is caused by a three-to-five fold increase in the pulmonary vascular resistance (PVR) and is associated with an increase in the right ventricular work.

Common symptoms of ARDS include dyspnea, tachypnea, dry cough, retrosternal discomfort, and agitation. In some aspects, the patient appears in moderate to severe respiratory distress and may have cyanosis. In some aspects, examination of the lungs reveals coarse crackles and bronchial breath sounds. In some aspects, the patient requires assisted mechanical ventilation.

SARS-CoV-2 can also have gastrointestinal affectations due to microinflammation, vascular damage and dysbiosis of the gastrointestinal tract. Consequently, between 9% to 34% of COVID-19 patients suffer from diarrhea. As discussed herein, the probiotic composition of the invention significantly shortens the duration of diarrhea in COVID-19 patients. The mean duration of diarrhea in patients receiving the probiotic composition was less than half than the mean duration of the placebo group. Accordingly, the experimental data herein provides evidence that it is plausible that the probiotic composition would have significant positive effects in the duration of gastrointestinal symptoms such as diarrhea caused by diseases and infections other than COVID-19.

Accordingly, in one embodiment, the infectious disease results in (i.e., induces) a gastrointestinal disease.

In one embodiment, the gastrointestinal disease is characterized by microinflammation, vascular damage and/or dysbiosis of the gastrointestinal tract.

In some embodiments, in relation to the infectious diseases and the resulting respiratory and/or gastrointestinal diseases, the administration of the probiotic composition results in the treatment, prevention or amelioration of at least one symptom selected from the group consisting of:—fever;

cough, particularly dry cough;
headache;
shortness of breath;
bodily pain, particularly muscle pain;
low oxygen saturation (hypoxemia) in blood, particularly an oxygen saturation SaO2 or SpO2<92%; and
diarrhea.

In some embodiments, the administration of the probiotic composition results in at least one outcome (i.e., effect) selected from the group consisting of:

remission of infectious disease;
reduction of the duration of symptoms;
reduction of viral load;
stimulation of antibodies production (i.e., increase of antibody levels);
particularly stimulation of IgG and IgM antibodies production; more particularly IgG antibody levels are at least doubled;
improvement of blood oxygen saturation (hypoxemia); and
reduction of the duration of low oxygen saturation in blood (i.e., hypoxemia).

In some embodiments, the administration of the probiotic composition results in at least one outcome (i.e., effect) selected from the group consisting of:

increase of interferon-beta levels, particularly interferon-beta levels are 20% increased; and —reduction of CXCL13 levels.

In some embodiments, the present disclosure provides a method to select a subject with a disease or condition disclosed herein (e.g., COVID-19) for treatment with the probiotic composition according to the invention, comprising determining whether a biomarker selected from the group consisting of lymphopenia, neutrophilia, activation of coagulation (as shown, e.g., by an increase in D-dimer values), acute kidney injury (as shown, e.g., by increased blood urea and creatinine), increased levels of IL-6, increase in cardiac troponin I in plasma, increase in lactate dehydrogenase in plasma, increase in ferritin in plasma, increased levels of IL-10, increased levels of TNFa, reduced levels of CD4+ T-cells, reduced levels of CD8+ T-cells, leukocytosis, increase in procalcitonin levels, decrease in expression of IFNy in CD4+ T-cells, increase in cytokine levels produced by highly inflammatory macrophages, or any combination is present, wherein the presence of the biomarker indicated that the subject can be treated with probiotic composition disclosed herein.

Medical Uses of the Probiotic Composition—Enhancing Immune Response

Protection against COVID-19 is mediated in large part by an immune response directed against the SARS-CoV-2 spike (S)-protein. The S-protein is responsible for virus-cell binding and is the target for virus-neutralizing antibodies. Functional neutralizing antibodies specific to SARS-CoV-2 that are produced following infection, vaccination, or both (anti-spike glycoprotein and anti-RBD) are considered important for viral neutralization and viral clearance and are quantified by use of in vitro neutralization assays. Therefore, potentiating the production of antibodies specific to SARS-CoV-2 is of great interest to achieve long-term immunity, derived both from an initial infection and/or a vaccine. Particularly, antibodies of the IgA type have been shown to dominate the immune response to SARS-CoV-2 during the early days of the infection, but rapidly wanes after the 3rd week of the infection, while antibodies of the IgG type markedly increase their positivity rate.

As discussed herein, the probiotic composition of the invention enhances the immune response of patients resulting in a significant increase in the concentration of antibodies of type IgG and IgM ($p<0.001$). Remarkably, at day 30 of intervention, subjects receiving the probiotic composition had IgG levels twice as high as those of subject in placebo group. Accordingly, the experimental data herein provides evidence that it is plausible that the probiotic composition would have significant positive effects in the stimulation of the immune response of patients, and particularly of the production of antibodies, derived both from an initial infection and/or a vaccine.

Furthermore, from the above-mentioned evidence it is plausible that the probiotic composition would also have significant positive effects in the stimulation of the immune response (e.g., increase the production of antibodies) derived from other infections (e.g., bacterial or viral infections) or vaccines, particularly in the case of viral infections and/or viral vaccines.

Accordingly, in some embodiments, the probiotic composition is used in enhancing, accelerating and prolonging the immune system response.

In a particular embodiment, the administration of the probiotic composition stimulates the production of antibodies (particularly IgG and/or IgM).

In one embodiment, the immune system response comprises the production of antibodies (particularly IgG and/or IgM), particularly IgG antibody levels are at least doubled.

In other embodiments, the probiotic composition is used as adjuvant, immunostimulant, immune potentiator, or immunomodulator.

In some embodiments, the probiotic composition disclosed herein can be administered in combination with other therapeutic and/or prophylactic treatments (e.g., anticoagulants, anti-inflammatories, or blood pressure regulators). The probiotic composition and the other treatment can be formulated for a separate, sequential, concomitant administration or in admixture.

In some embodiments, the probiotic composition is used concomitantly with other treatments used for respiratory infections, particularly respiratory infections of viral origin causing hypoxemia, particularly COVID-19, such as but not limited to corticosteroids (e.g., dexamethasone, prednisone, methylprednisolone, or hydrocortisone), antipyretics (e.g., acetaminophen or non-steroidal antiinflammatory drugs such as ibuprofen and similar compounds), virus-specific neutralizing antibodies (e.g., REGN-COV2), vaccines (e.g., RNA vaccines, vaccines using recombinant chimeric viruses or peptide vaccines), molecules with antiviral activity (e.g., interferon, plitidepsin, remdesivir, oseltamivir and similar compounds) or blocking cytokine signaling (e.g. tocilizumab).

In some embodiments, the probiotic composition is administered in combination with a vaccine. In an embodiment, the probiotic composition is for the concomitant use in combination with a vaccine.

In some embodiments, the probiotic composition is administered in combination with an antiinflammatory drug, e.g., an anti-inflammatory corticosteroid. Examples of corticosteroid are methylprednisolone, fludrocortisone, hydrocortisone, prednisone, prednisolone, flunisolide, fluticasone, beclomethasone, budesonide, ciclesonide, mometasone, and any combination thereof. In an embodiment, the probiotic composition is for the concomitant use in combination with an antiinflammatory drug.

In one embodiment, the probiotic composition is administered in combination with an antipyretic drug.

Products Comprising the Probiotic Compositions

In some embodiments, the bacterial strains described herein can be formulated for a separate, sequential, concomitant administration or in admixture. The administration regimens and forms will be determined by the skilled in the art. Administration of the bacterial strains can be administered separately (waiting a time interval between the administration of a first bacteria strain and a second bacteria strain), sequentially (one after the other), concomitantly (simultaneously) or in admixture (together). Therefore, they can be administered as separate forms or as a part of a single composition. When the products are administered in separate dosage forms, the dosage forms can be in the same or different containers or e.g., capsules or pills. In a particular embodiment, the strains described herein are administered in a single composition, e.g., a tablet.

The probiotic compositions described herein can be formulated as edible, pharmaceutical or veterinary products, in which the strains are the only active agents or are mixed with one or more other active agents and/or are mixed with pharmaceutically or veterinary acceptable excipients (in the case of a pharmaceutical or veterinary product) or adequate additives (in the case of an edible product). Preferably, the additional active agent or agents are other probiotic bacteria which are not antagonistic to the strains forming the composition of the invention. Depending on the formulation, the strains may be added as purified bacteria, as a bacterial culture, as part of a bacterial culture, as a bacterial culture which has been post-treated, and alone or together with suitable carriers or ingredients. Prebiotics such as fructooligosaccharides (particularly inulins), galactooligosaccharides, xylo-oligosaccharides, arabinoxylan-oligosaccharides, pectins, beta-glucans or partially hydrolyzed guar gum can be added also.

In some embodiments, the probiotic composition is in the form of a pharmaceutical composition comprising an effective amount of the probiotic composition and at least one pharmaceutically acceptable excipient.

In particular embodiments, the compositions of the invention are formulated as pharmaceutical products, particularly, as food supplements. The term "pharmaceutical product" is understood in its widest meaning in this description, including any composition that comprises an active ingredient, in this case, the strains described herein particularly in form of composition together with pharmaceutically acceptable excipients. This term is not limited to medicaments.

The term "pharmaceutically acceptable" is art-recognized, and includes compounds, materials, compositions, carriers, vehicles and/or dosage forms which are, within the scope of sound medical judgment, suitable for use in contact with the tissues of a subject (e.g., human) without excessive toxicity, irritation, allergic response, or other problem or complication, commensurate with a reasonable benefit/risk ratio. Each carrier, excipient, etc. must also be "acceptable" in the sense of being compatible with the other ingredients of the formulation. Suitable carriers, excipients, etc. can be found in standard pharmaceutical texts. Some non-limiting examples of materials which may serve as pharmaceutically acceptable carriers include: sugars, such as lactose, glucose and sucrose; starches, such as corn starch and potato starch;

cellulose, and its derivatives, such as sodium carboxymethyl cellulose, ethyl cellulose and cellulose acetate; powdered tragacanth; malt; gelatin; talc; cocoa butter and suppository waxes; oils, such as peanut oil, cottonseed oil, sunflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and other non-toxic compatible substances employed in pharmaceutical formulations.

Excipients are selected, without limitation, from the group comprising: fillers/diluents/bulking agents, binders, antiadherents, disintegrants, coatings, anti-caking agents, antioxidants, lubricants, sweeteners, flavors, colors, tensides and other classes of pharmaceutically and veterinary acceptable excipients.

Fillers are selected, without limitation, from the group comprising: inulin, oligofructose, pec-tin, modified pectins, microcrystalline cellulose, lactose, starch, maltodextrin, saccharose, glucose, fructose, mannitol, xylitol, non-crystallizing sorbitol, calcium carbonate, dicalcium phosphate, other inert inorganic and organic pharmacologically acceptable fillers, and mixtures of these substances. At dosage form of oral suspension, fillers or diluents are selected from the group comprising: vegetable oil, oleic acid, oleyl alcohol, liquid polyethylene glycol, other pharmacologically acceptable inert liquids, or mixtures of these substances.

Binders are used in solid dosage forms, e.g., to hold the ingredients in a tablet together, to ensure that tablets and granules can be formed with required mechanical strength, and to give volume to low active dose tablets. Binders in solid dosage forms like tablets are: lactose, sucrose, corn (maize) starch, modified starches, microcrystalline cellulose, modified cellulose (e.g., hydroxypropylmethylcellulose (HPMC) and hydroxyethylcellulose), other water-soluble cellulose ethers, polyvinylpyrrolidone (PVP) also known as povidone, poly-ethylene glycol, sorbitol, maltitol, xylitol and dibasic calcium phosphate; other suitable pharmacologically acceptable binders, or mixtures of these substances.

Antiadherents are used to reduce the adhesion between the powder (granules) and the punch faces and thus prevent sticking to tablet punches. They are also used to help protect tablets from sticking. The most commonly used is magnesium stearate.

As disintegrants and superdisintegrants in solid dosage forms like tablets and capsules, the following substances, without limitation, are used: cross-linked polyvinylpyrrolidone, sodium starch glycolate, sodium carboxymethyl cellulose, calcium carboxymethyl cellulose, and formaldehyde-casein, other suitable pharmacologically acceptable disintegrant and superdisintegrant, or their mixtures.

Coatings in the case of solid dosage forms, such as tablets and granules for capsule filling, protect the ingredients from deterioration by moisture in the air, make large, unpleasant-tasting tablets easier to swallow and/or in the case of enteric coatings ensure intact passage through a strong acidic medium of gastric juice (pH around 1), and which allow release in duodenum or ileum (small intestine). For most coated tablets, a cellulose ether hydroxypropyl methylcellulose (HPMC) film coating is used. Occasionally, other coating materials are used, e.g., synthetic polymers and co-polymers like polyvinylacetate phthalate (PVAP); co-polymers of methyl acrylate-metacrylic acid; copolymers of methyl metacrylate-metacrylic acid; shellac, corn protein zein or other polysaccharides; waxes or wax-like substances such as beeswax, stearic acid; higher fatty alcohols like cetyl or stearyl alcohol; solid paraffin; glycerol monostearate; glycerol distearate, or their combinations. Capsules are coated with gelatin or hydroxypropyl methylcellulose.

Enteric coatings control the rate of drug release and determine where the drug will be released in the digestive tract. Materials used for enteric coatings include fatty acids, waxes, shellac, plastics, and plant fibers and their mixtures, also in combination with other above-mentioned coatings.

An anticaking agent is an additive placed in powdered or granulated materials to prevent the formation of lumps (caking) and for easing packaging, transport, and consumption. As anti-caking agents in solid dosage forms like tablets, capsules, or powders, the following are used: magnesium stearate, colloidal silicon dioxide, talc, other pharmacologically acceptable anticaking agents, or their mixtures.

Lubricants are used in solid dosage forms, in particular in tablets and capsules, to prevent ingredients from clumping together and from sticking to the tablet punches or capsule filling machine, and also in hard capsules. As lubricants talc or silica, and fats, e.g., vegetable stearin, magnesium stearate or stearic acid, and mixtures thereof, are the most frequently used lubricants in tablets or hard gelatin capsules.

Sweeteners are added to make the ingredients more palatable, especially in solid dosage forms, e.g., chewable tablets, as well as in liquids dosage forms, like cough syrup. Sweeteners may be selected from artificial, natural or synthetic or semi-synthetic sweeteners; non-limiting examples of sweeteners are aspartame, acesulfame potassium, cyclamate, sucralose, saccharine, sugars or any mixture thereof, Flavors can be used to mask unpleasant tasting active ingredients in any dosage form. Flavorings may be natural (e.g., fruit extract) or artificial. For example, to improve: (1) a bitter product, mint, cherry or anise may be used; (2) a salty product, peach or apricot or liquorice may be used; (3) a sour product, raspberry; and (4) an excessively sweet product, vanilla.

Except auxiliary substances from the class of excipients, the formulation from the present invention can contain other pharmacologically active or nutritive substances including, but not limited, to vitamins, such as vitamin D (calciferol) in the pharmaceutically acceptable chemical form, salt or derivatives; minerals in the form of pharmaceutically and nutritive acceptable chemical form; and L-amino acids. Regarding the preparation of the formulations of the present invention, it is within the scope of ordinary person skilled in the art and will depend upon the final dosage formulation. For instance, and without limitation, when the final dosage form is an oral solid one, such as tablets, capsules, powder, granules, oral suspension, etc. the process for preparation of solid dosage forms of the formulation includes homogenization of: (1) the active ingredient(s), comprising at least one or more post-treated probiotic bacteria of the invention in an effective amount; (2) with one or more excipients to form homogeneous mixture which is, e.g., according to requirements, subjected to lubrication with magnesium stearate or other lubricants yielding final dosage form of powder. Such homogeneous powder is filled into ordinary gelatin capsules or, alternatively, into gastro-resistant capsules. In the case of tablets, they are manufactured by direct compression or granulation. In the first case, a homogeneous mixture of active ingredients and suitable excipients such as anhydrous lactose, non-crystallizing sorbitol, and others is prepared. In the second case, tablets are processed of the mixture in granulated form. Granules are prepared by granulation process of active ingredients of the formulation with suitable fillers, binders, disintegrants, and small amount of purified water. Such pre-pared granules are sieved and dried until the water content of <1% w/w.

Regarding the process for preparation of liquid dosage forms (e.g., oral suspension), it involves homogenization of the active ingredient(s) of the formulation comprising at least one or more posttreated probiotic bacteria of the invention in an effective amount in an inert liquid diluent (filler) such as various vegetable oils like sunflower, soybean or olive oil; oleic acid; oleyl alcohol; liquid polyethylene glycols like PEG 200, PEG 400 or PEG 600; or other inert pharmacologically acceptable liquids. The process further involves treatment of homogeneous mixture with one or more processes selected from the group comprising: (1) stabilization of the formulation, by addition and homogenization of suspension stabilizers like beeswax, colloidal silicon dioxide, etc.; (2) sweetening of the formulation, by addition and homogenization of sweetener; (3) flavoring of the formulation, by addition and homogenization of flavoring. Such forms of the formulation can contain also other excipients or ingredients usually employed in the art.

The pharmaceutical product can adopt different forms or names depending on the product approval route and also depending on the country. For instance, a medicament is a particular pharmaceutical product. A medical food is another particular pharmaceutical product. The terms "medical food" or "food for special medical purposes" are used in some countries to refer to a food specially formulated and intended for the dietary management of a disease that has distinctive nutritional needs that cannot be met by normal diet alone. They are defined in regulations such as the Food and Drug Administration's 1988 Orphan Drug Act Amendments in the United States, and the Commission Directive 1999/21/EC in Europe. Medical foods are distinct from the broader category of food supplements and from traditional foods that bear a health claim. Thus, in a particular embodiment, the strains of the invention are formulated as a medical food.

In some embodiments, the probiotic composition is in the form of a dietary supplement comprising the probiotic composition and at least one acceptable excipient.

Particularly, the probiotic composition is in the form of capsules, tablets, pills, sachets, or a suspension (e.g., in an oil). Particularly, the capsule, tablet, or pill have a weight of about 350 mg to about 450 mg, more particularly, 400 mg. Particularly, the sachet has a weight of about 2 g to about 6 g.

In a particular embodiment the probiotic composition is in the form of a vegetable capsule and comprises HMPC.

A food supplement, also known as dietary supplement or nutritional supplement is considered another particular pharmaceutical product. This is a preparation or product intended to supplement the diet, made from compounds usually used in foodstuffs, which provide nutrients or beneficial ingredients that are not usually ingested in the normal diet or may not be consumed in sufficient quantities. Mostly, food supplements are considered as food products, but sometimes they are defined as drugs, natural health products, or nutraceutical products. In the sense of the present invention, food supplements also include nutraceuticals. Food supplements are usually sold "over the counter", i.e., without prescription. If the food supplement adopts the form of a pill, a capsule a tablet or a powder, it comprises excipients which are the same as the used in medicaments. A food supplement however, can also adopt the form of a food product which is fortified with some nutrients (e.g., a bar or yoghurt).

Thus, in a particular embodiment, the probiotic compositions are formulated as a food supplement or dietary supplement. The dietary supplement can be administered as such, can be mixed with a suitable drinkable liquid, such as water, yoghurt, milk or fruit juice, or can be mixed with solid or liquid food. In this context the food supplement can be in the form of tablets or lozenges, pills, capsules, granules, powders, suspensions, sachets, sweets, bars, syrups and corresponding administration forms, usually in the form of a unit dose.

In some embodiments, the probiotic composition is in the form of an oily suspension to be administered alone or mixed with a liquid. The oily suspension comprises at least one edible oil such as olive oil, maize oil, soybean oil, linseed oil, sunflower oil or rice oil. The oil is present in a quantity of at least 70% weight/weight. In a particular embodiment, the oily suspension also comprises at least one excipient which is an emulsifier, stabilizer or anti-caking agent, in an amount of 0.1-15% w/w. Suitable agents are silicon dioxide, silica gel, colloidal silica, precipitated silica, talc, magnesium silicate, lecithin, pectin, starch, modified starches, konjac gum, xanthan gum, gellan gum, carrageenan, sodium alginate, mono- or diglycerides of fatty acids such as glycerol monostearate or glycerol monooleate and citric acid esters of mono- or diglycerides.

Particularly, the probiotic composition is in the form of an infant food supplement in the form of oily suspension. In a particular embodiment the oily suspension comprises sunflower oil and colloidal silica, particularly at 1% by weight, and the bacterial cells.

In another embodiment the oily suspension comprises sunflower oil and an agent selected from lecithin, mono- or diglycerides of fatty acids, carrageenan and sodium alginate, and the bacterial cells.

In some embodiments, the probiotic composition is in the form of an edible product comprising the probiotic composition and at least one edible ingredient. Particularly, the edible product can be a dairy product, milk, yogurt, curd.

The compositions of the invention also can be included in a variety of food products or edible compositions, such as a milk product (a yogurt, a cheese, a fermented milk, a milk powder, a milk based fermented product, an ice-cream, a fermented cereal based product, a milk based powder), bread, bars, spreads, biscuits and cereals, a beverage, different types of oil, or a dressing. The term "food product" is used herein in its broadest meaning, including any type of product, in any form of presentation, which can be ingested by an animal, but excluding pharmaceutical and veterinary products. Examples of other food products are meat products, chocolate spreads, fillings and frostings, chocolate, confectionery, baked goods, sauces and soups, fruit juices and coffee Whiteners. Particularly interesting food products are food supplements and infant formulas. The food product particularly comprises a carrier material such as oat meal gruel, lactic acid fermented foods, resistant starch, dietary fibres, carbo-hydrates, proteins and glycosylated proteins. In a particular embodiment the strains of the invention are encapsulated or coated. Particularly, milks can be either of animal or vegetable origin.

In an embodiment, the probiotic composition is in the form of vegetable capsules (e.g., with hydroxymethylpropyl-cellulose, HMPC) filled with powder containing *L. plantarum* DSM 33765 (e.g., 1 billion lyophilized colony forming units (CFUs)) along with *L. plantarum* CECT 7484, *L. plantarum* CECT 7485 and *P. acidilactici* CECT 7483 (e.g., 1 billion lyophilized CFUs), together with a carrier (e.g., maltodextrin, potato starch, dextrose).

In another embodiment, the probiotic composition is in the form of an aluminum sachet containing the bacterial strains (e.g., in the same amounts described above), a carrier (e.g., maltodextrin, dextrose, rice fiber, potato starch), a sweetener (e.g., sucralose, sodium saccharin) and a flavoring agent.

In another embodiment, the probiotic composition is in the form of a bottle containing the bacterial strains (e.g., in the same amounts described above) in suspension in sunflower oil, to be administered as drops.

In some embodiments, the probiotic composition of the present disclosure is administered immediately after the onset of a disease disclosed herein or after the detection of the infection. In some embodiments, additional doses of the composition of the present disclosure are subsequently administered after an initial dose.

In some embodiments, the probiotic composition is administered in a single dose or repeated dose at specific time intervals, e.g., can be administered daily for a specific number of days or according to a specific dosing schedule. Particularly, the probiotic composition is administered during from 10 days to 90 days. More particularly, it is administered during from 10 days to 60 days or from 15 to 45 days, more particularly during 30 days.

In some embodiments, the probiotic composition is administered from once every three days to thrice a day, particularly, once a day.

In some embodiments, the probiotic composition of the present disclosure can be administered via e.g., oral, intrapulmonary, intravenous, intramuscular, or subcutaneous. Particularly, the probiotic composition is administered orally. In other embodiments, the probiotic composition can be administered by nasal inhalation, oral spray via or nasogastric route.

EXAMPLES

Example 1: Isolation and Characterization of Strain *L. plantarum* CECT 30292 (DSM 33765)

Deposit numbers CECT 30292 and DSM 33765 are used indistinguishably.

1.1. Isolation of the Strain

A novel strain of *L. plantarum* deposited as DSM 33765 was isolated both from humans (fecal sample) and chicory (*Cichorium intybus*) by diluting plant extract on phosphate-buffered saline buffer (PBS), and subsequently seeding on Man-Rogosa-Sharpe agar plates (MRS) and incubating under microaerophilic conditions (5% CO2) at 37° C.

1.2. Whole Genome Sequencing

Strain *L. plantarum* DSM 33765 was grown for 8 h in MRS liquid broth at 37° C. and cells were collected by centrifugation at early log phase. Total genomic and plasmidic DNA was extracted with QIAamp DNA mini kit (Quiagen) following manufacturer instructions, with additional lysis step where the cells were incubated at 37° C. for 10 min in lysis buffer-added lysozyme at 20 mg/mL (Sigma Aldrich, Steinheim am Albuch, Germany) and mutanolysin at 40 U/mL (Sigma Aldrich). Template DNA was prepared with Sequel II Binding Kit 2.0 (Pacific Bioscience), sequenced with PacBioRSII at TAKARA BIO INC (Kaneka, Japan) and assembled with software SMRT Link v8.0.0 (Pacific Bioscience).

Chromosome alignments between DSM 33765 and genome of reference *L. plantarum* WCSF1 strain [Kleerebezem et al. 2003] as well as the genomes of *L. plantarum* CECT 7484, CECT 7485 and ATCC 202195 were performed using the progressive MAUVE algorithm [Darling et al. 2004], Results of whole genome comparison (Table 1) unambiguously show strain DSM 33765 to be of the same species *L. plantarum* as the other strains, based on Average Nucleotide Identity over the whole genome (ANI) of >98.5%, clearly higher than the species boundary of 95% [Jain et al. 2018],

TABLE 1

Whole genome comparison based on ANI

| | Lp_ATCC 202195 | Lp_CECT 7484 | Lp_CECT 7485 | Lp_WCFS1 | Lp_DSM 33765 |
|---|---|---|---|---|---|
| Lp_ATCC | * | 98.61% | 98.64% | 98.61% | 98.64% |
| Lp_CECT 7484 | 98.77% | * | 98.77% | 98.80% | 99.55% |
| Lp_CECT 7485 | 98.83% | 98.83% | * | 98.93% | 98.70% |
| Lp_WCFS1 | 98.68% | 98.80% | 98.76% | * | 98.79% |
| Lp_DSM 33765 | 98.69% | 99.71% | 98.70% | 98.78% | * |

Moreover, tree analysis based on ANI (FIG. 1) shows the strain to belong to the same clade as CECT 7484 (ANI of 99.71%), while being more distantly related to reference strain WCFS1, as well as ATCC 202195 and CECT 7485 (ANI values of 98.7-98.8%).

1.3. Molecular Fingerprinting

Strain DSM 33765 was subjected to a previously described protocol [Rodas et al. 2005] with minor modifications. The strain was grown on MRS agar plates and incubated at 37° C. 5% CO2 for 18 h. Cells were harvested and washed 3 times in 8 ml PET (10 mM Tris pH 7.6, 1 M NaCl) then centrifuged at 6000 rpm 10 min. Pellets were resuspended in 700 ml lysis buffer (6 mM Tris, 1 M NaCl, 0.1 M EDTA, 0.5% SLS, 0.2% deoxycholic acid; 1 mg/ml lysozyme; 40 U/ml mutanolysin; 20 mg/ml RNase). An equal volume of 1.6% low melting point agarose (FMC BioProducts, Rockland, ME, USA) was added to the resuspended cells and solidification was allowed at 4° C. for 1 h. Inserts were transferred to 2 ml lysis buffer II (0.5 M EDTA pH 9.2, 1% N-lauryl sarcosine and 1 mg/ml pronase) and incubated at 50° C. for 48 h. Then, inserts were washed at room temperature with TE buffer (10 mM Tris, 1 mM EDTA pH 8.0). Total DNA digestion was performed by Sma-I restriction enzyme (Roche Diagnostics).

Pulse-field gel electrophoresis (PFGE) was carried out in duplicate using CHEF DRIII apparatus (BioRad Laboratories). Inserts were loaded in a 1% agarose gel (SeaKem ME agarose, FMC BioProducts, ME, USA). DNA MW (molecular weight) markers were Lambda ladder PFG Marker and Low Range PFG Marker (New England Biolabs). After electrophoresis, gels were stained with ethidium bromide and UV using GelDoc System (BioRad).

Results show the *L. plantarum* DSM 33765 strain has a reproducible PFGE profile, which is different than the profile of closely related strain *L. plantarum* CECT 7484. Particularly, compared to CECT 7484, strain DSM 33765 lacks a band of 97 kDa but has additional bands between 48.5 and 32.1 kDa. Hence, albeit closely related, both strains are demonstrated to be different one another.

1.4. Genome Annotation

General genome annotation was performed with software DFAST [Tanizawa et al. 2018] including the tRNAscan and Prodigal features, and the Conserved Domain Database [Shennan et al. 2020] Plasmids were identified using PlasmidDB software [Galata et al. 2019], In order to identify the presence of possible antibiotic resistance (AR) genes, the genome of *L. plantarum* DSM 33765 was compared against the last version of the Comprehensive Antibiotic Resistance Database (CARD), a bioinformatic database of resistance genes, their products, and associated phenotypes [Alcock et al. 2020] using the Resistance Gene Identifier (RGI), which supports analysis of whole genomes, using default parameters. As a double-check, the genome sequence was also compared against the last version of ResFinder database [Bortolaia et al. 2020], Results are shown in Table 2. PacBio sequencing of *L. plantarum* DSM 33765 resulted in four contigs comprising 3,322,082 bp. While the larger contig (3,237,983 bp) was identified as the chromosomic sequence, the three additional contigs (41,908 bp, 35,007 bp and 7,184 bp) were found to correspond to different *L. plantarum* plasmids.

No antibiotic resistance genes were found either in the bacterial chromosome or in the three plasmids. Two pilin genes and ten mucin-binding genes were identified, highlighting the adaptation of the strain to bind to mucus and epithelium and thus supporting its capacity to colonize the intestine.

TABLE 2

Characterization of *L. plantarum* DSM 33765 genome

| Contig | Length (bp) | tRNA genes | rRNA genes | Predicted genes (CDS) | AR genes | Mucin-binding and pilin genes | Molecule (Accession Num) |
|---|---|---|---|---|---|---|---|
| 1 SEQ ID NO: 5 | 3,237,983 | 76 | 46 | 3390 | None | 10 + 2 | Chromosome |
| 2 SEQ ID NO: 6 | 41,908 | 0 | 0 | 52 | None | None | Plasmid (CP017381.1 |
| 3 SEQ ID NO: 7 | 35,007 | 0 | 0 | 63 | None | None | Plasmid (CP050806.1 |
| 4 SEQ ID NO: 8 | 7,184 | 0 | 0 | 6 | None | None | Plasmid (CP028984.1 |
| Total | 3,322,082 | 76 | 46 | 3511 | None | 10 + 2 | |

1.5. Resistance to Gastric Conditions of Strain CECT 30292

Simulated gastric medium was prepared containing 7.3 g/L of sodium chloride, 0.5 g/L of potassium chloride, 3.8 g/L of sodium hydrogen carbonate and 3 g/L of pepsin in distilled water. Samples of said simulated medium were adjusted to pH 2.3 and to pH 3 using hydrogen chloride 1 N. 0.1 mL of overnight cultures of strain CECT 30292 were inoculated into 10 mL of simulated gastric medium at pH 2.3 or pH 3, thoroughly mixed and incubated for 30 min or 90 min at 37° C. Subsequently, 10-fold serial dilutions were prepared in buffered saline medium. Both 0.1 mL of the overnight culture and 0.1 mL of various serial dilutions were seeded into different MRS agar plates each. Colonies were counted after incubating at 37° C. for 48 h under anaerobic conditions. The experiment was performed in quadruplicate.

Results in Table 3 below show the strain is highly resistant to exposure to gastric medium:

| Condition | Inoculated cells log (CFUs/mL) | Surviving cells log (CFUs/mL) | Percent of survival (on absolute counts) |
|---|---|---|---|
| pH 2.3 for 30 minutes | 7.50 ± 0.02 | 7.45 ± 0.02 | 88.1% |
| pH 3.0 for 90 minutes | 7.48 ± 0.06 | 7.43 ± 0.10 | 87.6% |

Example 2: Clinical Study 2.1. Study Product

Vegetable capsules (hydroxymethylpropyl-cellulose, HMPC) were filled with powder containing 1 billion lyophilized cfus of novel strain *L. plantarum* DSM 33765 along with 1 billion lyophilized cfus of strains *L. plantarum* CECT 7484, *L. plantarum* CECT 7485 and *P. acidilactici* CECT 7483, together with a maltodextrin carrier. CFU load of the capsules was verified by serial dilution in PBS buffer followed by seeding in MRS agar and counting of colonies after 48 h of incubation at 37° C. under microaerophilic conditions.

2.2. Study Design

A quadruple blinded (patient, care provider, outcomes assessor and main investigator), randomized clinical trial was conducted against placebo to evaluate safety and efficacy of the combination of strain *L. plantarum* DSM 33765 and strains *L. plantarum* CECT 7484, *L. plantarum* CECT 7485 and *P. acidilactici* CECT 7483, at a total dose of 2 billion CFUs once daily in subjects with mild COVID-19. The trial adhered to the ethical tenets of the Declaration of Helsinki.

The primary aim was to improve COVID-19 severity, according to the World Health Organization scale [WHO Working Group. 2020], The secondary aims were to evaluate the effect of the above-mentioned combination in the reduction of the frequency and severity of individual COVID-19 symptoms, the reduction of viral load and the increase in levels of immunoglobulin antibodies IgG and IgM. 300 adults, aged 18 to 60 years, with positive nasopharyngeal detection of SARSCoV-2 with Real-Time Polymerase Chain Reaction method (PCR), with mild symptoms of COVID-19 (as per WHO COVID-19 severity scale) and providing written informed consent, were randomized. Individuals with blood oxygen saturation (SpO2)<90%, taking immunosuppressants, having acute pancreatitis or having regularly used other probiotics within two weeks of study initiation were excluded from participating. Randomization was performed according to a computer-generated list and all study participants (patients, care providers, outcomes assessor and main investigator) were blinded to whether they had been assigned to placebo or probiotic capsules. Probiotic and placebo capsules were indistinguishable one another. The computer-generated list was kept locked and in a sealed envelope by a pharmacist not participating in the study.

Individuals randomized to either probiotic or placebo were administered one capsule of their assigned intervention once daily for 30 consecutive days. COVID-19 symptoms were evaluated every 5 days. Quantification of SARSCoV-2 viral load in nasopharyngeal swabs was performed on days 0, 15 and 30 of the intervention. Quantification of specific IgG and IgM antibodies against SARSCoV-2 was performed in blood samples on days 0, 15 and 30 of the intervention.

2.3. Characteristics of the Subjects Recruited at Baseline

The probiotic and placebo groups in the study were balanced regarding clinical and demographic characteristics at baseline (Table 4).

TABLE 4

Characteristics of subjects at baseline.

| Characteristics of subjects at baseline | Probiotic (n = 150) | Placebo (n = 150) |
|---|---|---|
| Mild COVID-19 symptoms (n, %) | 150 (100) | 150 (100) |
| Women (n, %) | 82 (54.7) | 79 (52.7) |
| Age (median, min-max) | 34 (19-60) | 39 (18-59) |
| Days since onset of symptoms | 4.6 ± 2.9 | 5.3 ± 3.9 |
| Blood Group | | |
| O+ (n, %) | 66 (44.0) | 55 (38.7) |
| A+ (n, %) | 48 (32.0) | 52 (34.7) |
| B+ (n, %) | 16 (10.7) | 14 (9.3) |
| Other (n, %) | 20 (13.3) | 29 (17.3) |
| Smoker (n, %) | 22 (14.7) | 20 (13.3) |
| Diabetes (n, %) | 15 (10.0) | 16 (10.7) |
| Hypertension (n, %) | 28 (18.7) | 31 (20.7) |
| Body Mass Index in $Kg/m^2$ (Average ± SD) | 27.7 ± 4.9 | 29.6 ± 3.9 |
| Days since symptoms started (Average ± SD) | 3.9 ± 1.3 | 4.0 ± 1.3 |
| Viral load as Log of Copies/pl (Average ± SD) | 3.7 ± 0.22 | 3.8 ± 0.21 |
| SARSCoV-2 IgG in U/ml (Average ± SD) | 9.2 ± 7.1 | 8.3 ± 6.4 |
| SARSCoV-2 IgM in U/ml (Average ± SD) | 18.0 ± 3.7 | 18.0 ± 2.7 |
| Fever (n, %) | 73 (48.7) | 67 (44.7) |
| Mild | 23 (15.3) | 23 (15.3) |
| Moderate to severe | 50 (33.4) | 44 (29.4) |
| Cough (n, %) | 115 (76.7) | 111 (74.0) |
| Mild | 28 (18.7) | 22 (14.7) |
| Moderate to severe | 87 (58.0) | 89 (59.3) |
| Headache (n, %) | 109 (72.7) | 110 (73.3) |
| Mild | 6 (4.0) | 7 (4.7) |
| Moderate to severe | 103 (68.7) | 104 (69.3) |
| Shortness of breath (n, %) | 46 (30.7) | 30 (20.0) |
| Mild | 39 (26.0) | 27 (18.0) |
| Moderate to severe | 7 (4.7) | 3 (2.0) |
| Bodily pain (n, %) | 69 (46.0) | 78 (52.0) |
| Mild | 22 (14.7) | 28 (18.7) |
| Moderate to severe | 47 (31.3) | 50 (33.3) |
| Oxygen saturation (n, %) | | |
| $SpO_2$ > 92% | 21 (14.0) | 35 (23.3) |
| $SpO_2$ 90 to 92% | 129 (86.0) | 115 (76.7) |

SD = Standard Deviation.

2.4. Results

During the 30-day intervention, only 3 subjects dropped from the study in the probiotic group and 4 in the placebo group. No patients died or required Intensive Care Unit during the 30-day intervention.

Complete remission of COVID-19: Complete remission of COVID-19 is defined as complete disappearance of symptoms along with a negative PCR result (i.e., a score of zero in the WHO COVID-19 severity scale). No patients displayed complete remission on day 15 of the intervention. However, a much higher number of patients displayed complete remission in the probiotic group than in the placebo group on day 30 of the intervention, the difference being highly statistically significant (p-value <0.001, as per a Chi-squared test). See Table 5.

Symptomatic remission: Symptomatic remission was defined as complete disappearance of symptoms regardless of PCR result (i.e., a score of zero or one in the WHO COVID-19 severity scale). Patients receiving probiotic displayed remission at earlier stages of the intervention (i.e., days 10, 15 15 and 20) than those receiving placebo. See Table 5.

TABLE 5

Complete remission of COVID-19 and symptomatic remission.

| | Probiotic | Placebo |
|---|---|---|
| Complete Remission | | |
| Day 15 (n, %) | 0 (0.0) | 0 (0.0) |
| Day 30 (n, %) | 82 (55.8)* | 41 (28.1)* |
| Symptomatic Remission | | |
| Day 5 (n, %) | 0 (0.0) | 0 (0.0) |
| Day 10 (n, %) | 42 (28.0)* | 13 (8.7)* |
| Day 15 (n, %) | 126 (84.0)* | 82 (54.7)* |
| Day 20 (n, %) | 150 (100.0)* | 127 (85.2)* |
| Day 25 (n, %) | 148# (100.0) | 145 (98%) |
| Day 30 (n, %) | 147# (100.0) | 146# (100%) |
| Requiring Intensive Care Unit or death (n, %) | 0 (0.0) | 0 (0.0) |

#Updated total number of subjects considering subjects dropping the study at different evaluation days.
*Statistically significant at p-value < 0.001.

Figure 3:
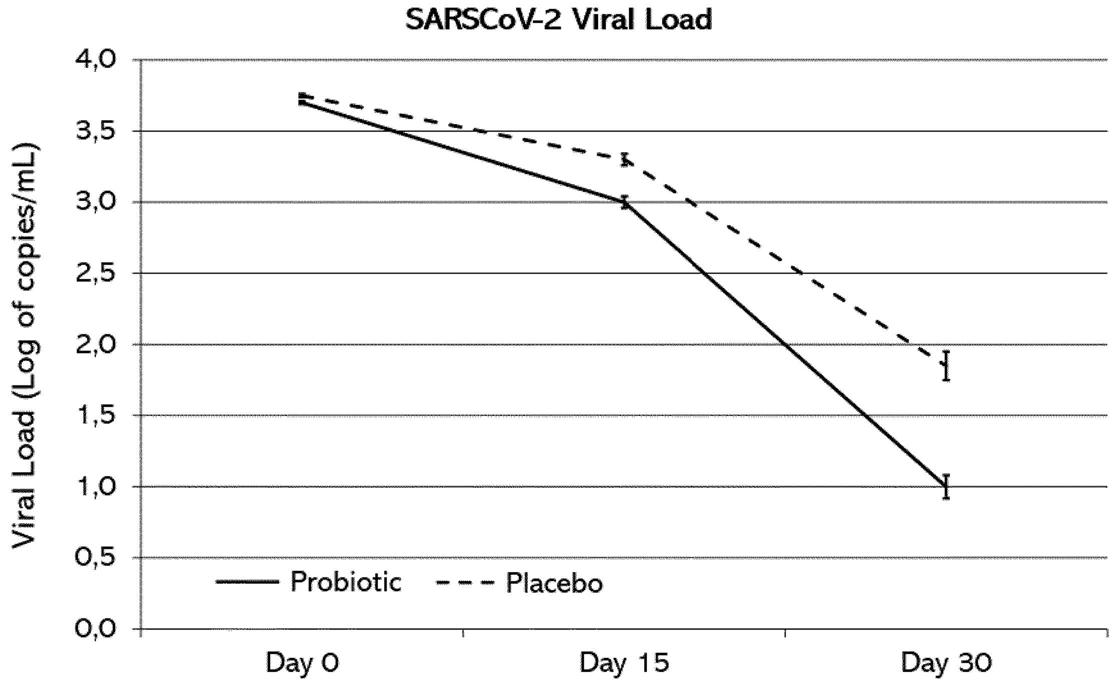
FIG. 3 shows the concentration of the viral load of SARS-CoV-2 in nasopharyngeal swabs at days 0, 15 and 30 of intervention for Probiotic and Placebo group. At day 30, the difference averaged 0.9 log, thus concentration was reduced 9 times on average. See working Example herein for further details.

Viral load: During the 30-day intervention, the concentration of the viral load in nasopharyngeal swabs was further reduced in the probiotic group than in the placebo group, the difference being highly statistically significant (p<0.001, as per repeated measures ANOVA), as can be seen FIG. 3. At the end of the 30-day intervention, the difference averaged 0.9 log, thus concentration was 25 reduced 9 times on average.

Figure 4:
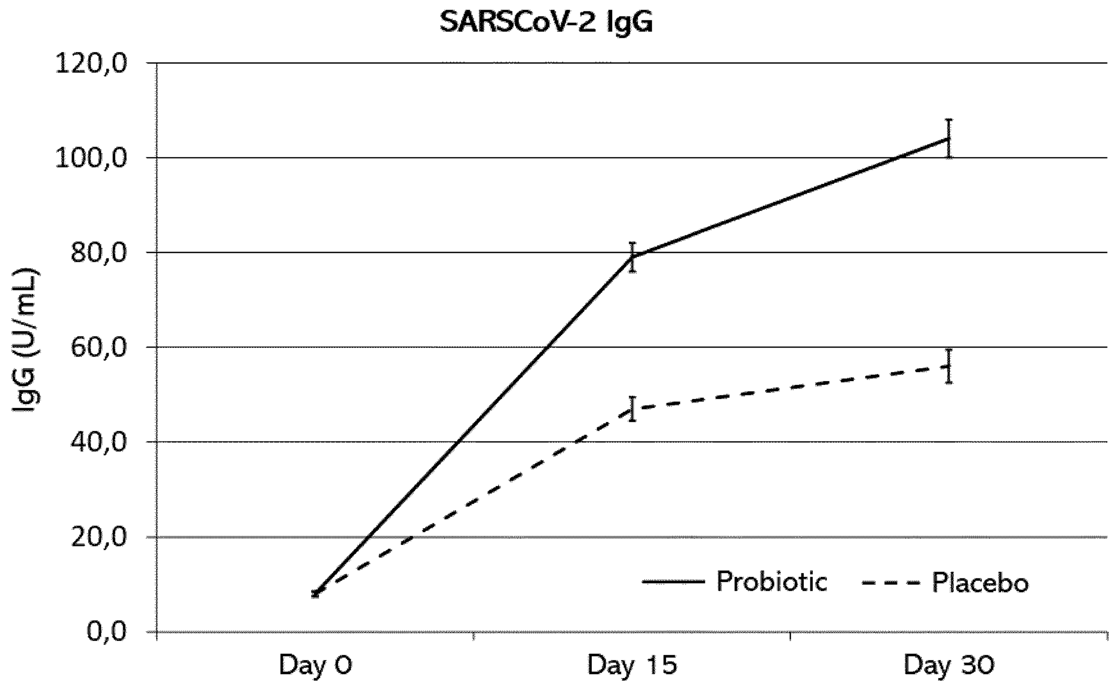
FIG. 4 shows the concentration of IgG and IgM antibodies against SARS-CoV-2 at days 0, 15 and 30 of intervention for Probiotic and Placebo group. At day 30, subjects receiving probiotic had IgG levels twice as high as those of subject in placebo group. See working Example herein for further details.
Figure 4:
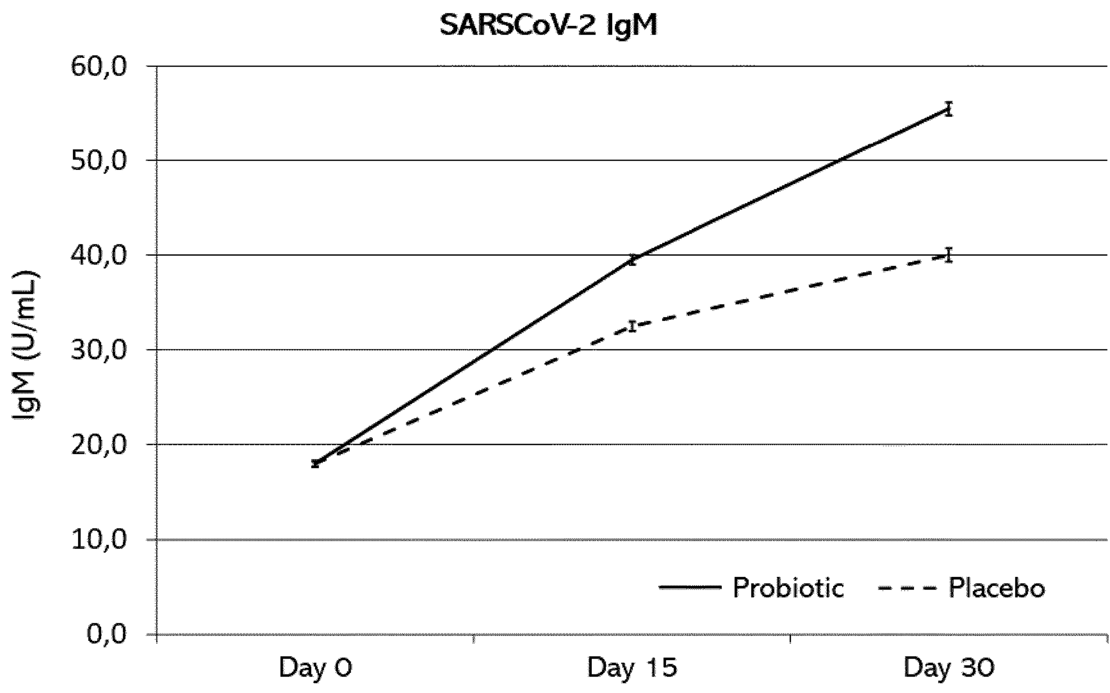

Concentration of IG and IM antibodies: During the 30-day intervention, the concentration of IgG and IgM antibodies against SARS-CoV-2 was further increased in the probiotic group than in the placebo group, the difference being highly statistically significant (p<0.001, as per repeated measures ANOVA), as can be seen in FIG. 4. At the end of the 30-day intervention, subjects receiving probiotic had IgG levels twice as high as those of subject in placebo group.

Statistical adjustments were performed to assess whether age, blood group, body mass index, concurrent diabetes or concurrent hypertension modulated the effect of the probiotic on remission rate, viral load and antibody levels. Remarkably, none of these variables were found to modulate the effect of the probiotic intervention. Therefore, probiotic achieved its beneficial effect regardless of age, blood group, body mass index, concurrent diabetes or concurrent hypertension.

Reduction of specific symptoms of COVID-19: During the 30-day intervention, probiotic intervention was also found to significantly reduce the duration of various specific symptoms of COVID-19, compared to placebo, as well as the days with blood oxygen saturation below 92% (hypoxemia), the later despite a higher proportion of subjects with saturation below 92% at baseline in the probiotic group (all with p<0.05, as per Mann-Whitney test). See Table 6.

TABLE 6

| Reduction of specific symptoms of COVID-19 | | | |
|---|---|---|---|
| Symptoms | Probiotic | Placebo | P-value |
| Fever (mean, SD) | 9.2 ± 3.9 | 10.8 ± 4.6 | 0.005 |
| Cough (mean, SD) | 10.1 ± 4.7 | 13.5 ± 6.5 | 0.001 |
| Headache (mean, SD) | 6.9 ± 4.0 | 10.6 ± 6.5 | 0.001 |
| Shortness of breath (mean, SD) | 1.1 ± 1.6 | 2.2 ± 3.1 | 0.021 |
| Bodily pain (mean, SD) | 2.9 ± 2.8 | 5.0 ± 4.4 | 0.001 |
| Oxygen saturation (SpO2) < 92% (mean, SD) | 7.4 ± 3.6 | 8.4 ± 4.0 | 0.036 |
| Diarrhea (mean, SD) | 1.8 ± 2.8 | 4.4 ± 6.4 | 0.010 |

Example 3: Serum Concentration Measurement of Interferon-Beta (IFNb) and Chemokine CXCL13

3.1. Methods 70 individuals were randomly chosen from the 300 individuals described in EXAMPLE 2. Randomization was primarily stratified by intervention group to ensure that 35 individuals corresponded to placebo group and 35 to probiotic group as well as by lung infiltration status at the beginning of the intervention and by responder status at the end of the intervention, in order to ensure that the selected subpopulation of 70 individuals had a similar distribution than the full population of 300 individuals.

Stored, frozen serum samples taken on days 0, 15 and 30 of intervention (See EXAMPLE 2) were used to measure interferon-beta (IFNb) and the chemokine CXCL13 using standard Enzyme-Linked ImmunoSorbent Assay (ELISA) laboratory kits. Digital lung X-ray scans taken on days 0, 15 and 30 were also retrieved from patients records, and lung inflammatory infiltrates were scored, whenever present, using the validated Brixia score (the higher the score, the more severe the inflammatory infiltrate) [Borghesi et al., 2020], 3.2. Results Clinical characteristics of the subjects: The probiotic and placebo groups in the subpopulation of 70 subjects were balanced regarding clinical and demographic characteristics at baseline (Table 7).

TABLE 7

| Characteristics of the 70 subjects at baseline. | | |
|---|---|---|
| | Probiotic (n = 35) | Placebo (n = 35) |
| Women (n, %) | 22 (62.9%) | 22 (62.9%) |
| Age (Average ± SD) | 36.1 ± 12.0 | 38.3 ± 14.4 |
| Number of metabolic comorbidities [median, range]* | 0 [0-2] | 0 [0-3] |
| Days since symptom onset (Average ± SD) | 4.1 ± 1.2 | 3.9 ± 1.3 |
| Viral load as Log of Copies/ml (Average ± SD) | 6.7 ± 0.3 | 6.8 ± 0.2 |
| SARSCoV-2 IgG in U/ml (Average ± SD) | 9.9 ± 7.5 | 7.7 ± 6.6 |
| SARSCoV-2 IgM in U/ml (Average ± SD) | 17.6 ± 3.8 | 18.3 ± 2.6 |
| Presence of lung infiltrates (n, %) | 15 (42.9%) | 11 (31.4%) |

*Comprising diabetes, arterial hypertension and obesity (i.e., body mass index ≥ 30 $Kg/m^2$)
SD = Standard Deviation.

Figure 5:
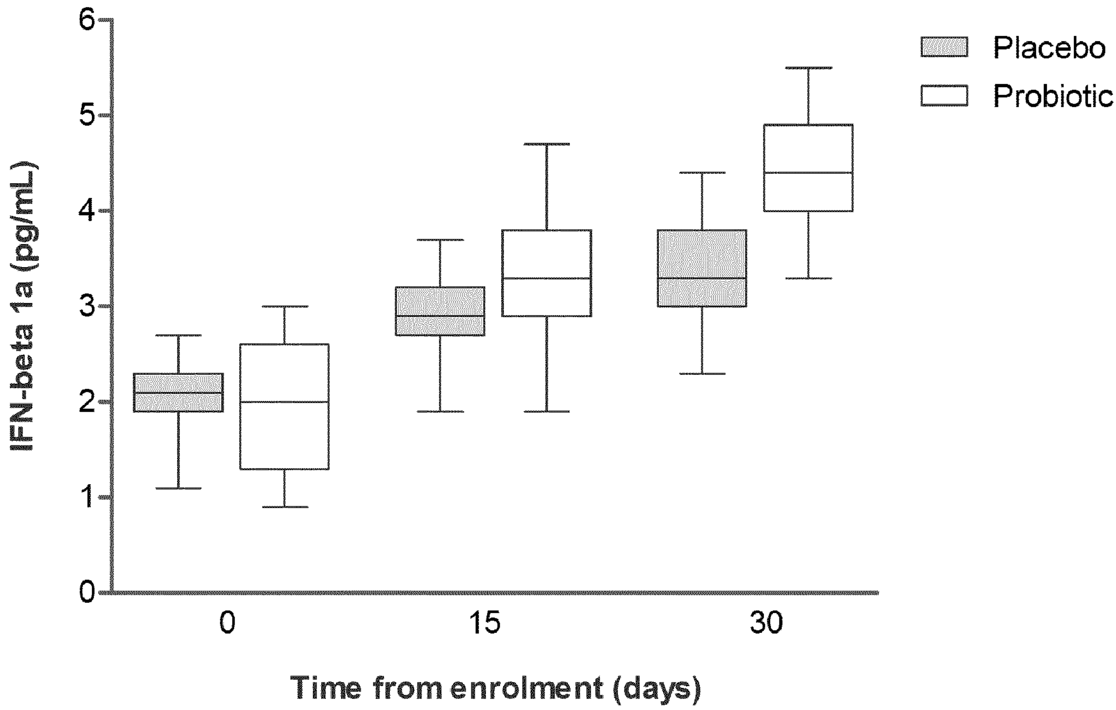
FIG. 5 shows serum concentration of interferon-beta 1a (INFb) at days 0, 15 and 30 of intervention for Probiotic and Placebo group. At day 30, subjects receiving probiotic had INFb levels significantly increased with respect to the placebo group. See working Example herein for further details.

Serum concentration of interferon-beta: At baseline, the levels of IFNb were indistinguishable between probiotic and placebo groups. During the 30-day intervention, the levels of IFNb were significantly increased in probiotic group compared to placebo (p<0.001, repeated-measures ANOVA) as seen in FIG. 5. More precisely, concentration in probiotic group was significantly higher both on day 15 and on day 30 compared to placebo (p<0.05).

Figure 6:
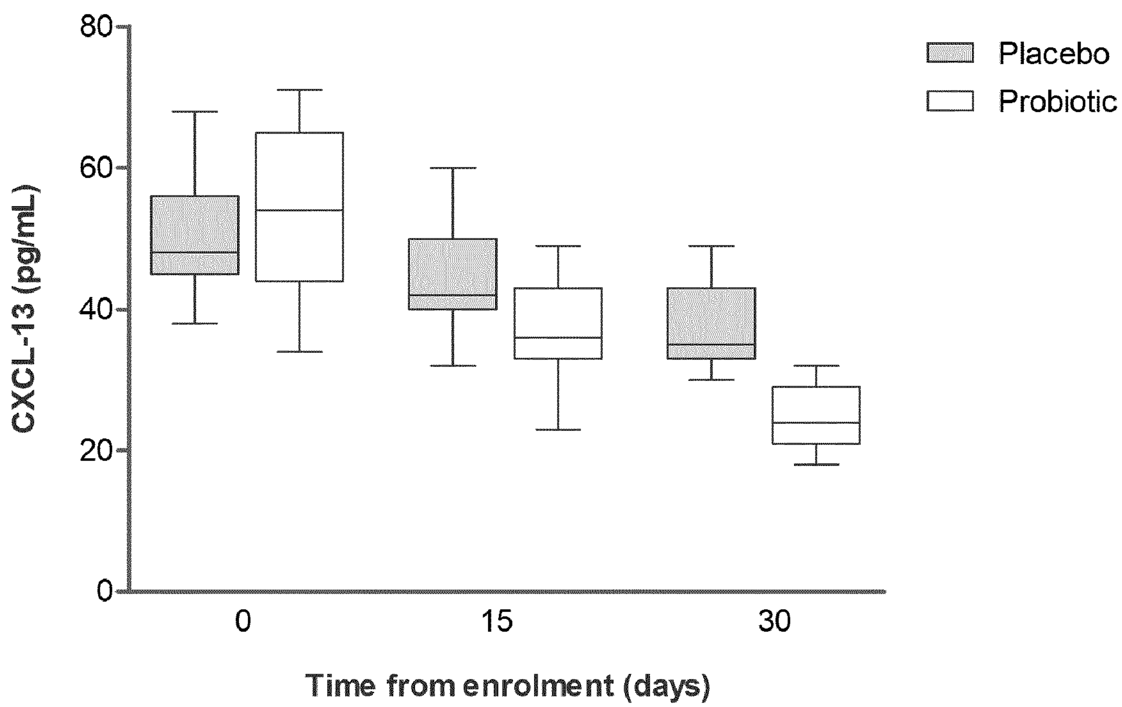
FIG. 6 shows serum concentration of CXCL13 at days 0, 15 and 30 of intervention for Probiotic and Placebo group. Concentration in probiotic group was significantly lower both on day 15 and on day 30 compared to placebo. See working Example herein for further details.

Serum concentration of CXCL13: At baseline, the levels of CXCL13 were indistinguishable between probiotic and placebo groups. During the 30-day intervention, the levels of CXCL13 were significantly reduced over time in the probiotic group compared to placebo (p<0.001, repeated-measures ANOVA) as seen in FIG. 6. More precisely, concentration in probiotic group was significantly lower both on day 15 and on day 30 compared to placebo (p<0.05).

Clearance of symptoms: The 70 subjects reported daily their symptoms in a patient electronic diary. The duration of several symptoms was significantly shorter in probiotic group compared to placebo group, as indicated in Table 8.

TABLE 8

| Duration of various viral infection symptoms (average and standard deviation). | | | |
|---|---|---|---|
| | Probiotic (n = 35) | Placebo (n = 35) | P-value (Student T test) |
| Days with fever (>37.5° C.) | 3.6 ± 3.5 | 6.1 ± 3.4 | p = 0.003 |
| Days with cough | 9.4 ± 4.9 | 12.7 ± 6.3 | p = 0.016 |
| Days with headache | 6.0 ± 4.0 | 9.1 ± 6.6 | p = 0.023 |
| Days with body aches | 1.7 ± 2.5 | 4.4 ± 4.1 | p = 0.001 |

As a further confirmation of the positive role of type-1 interferons against viral infection, higher levels of interferon-beta correlated to less days with fever (Spearman correlation=−0.24, p-value=0.042) and less days with cough (Spearman correlation=−0.26, p-value=0.033) in the overall population of 70 subjects. A similar trend (i.e., a p-value above 0.05 but below 0.10) was also observed for body aches (Spearman correlation=−0.21, p-value=0.075). Moreover, lower levels of CXCL13 also correlated to less days with fever (Spearman correlation=0.27, p-value=0.024).

In the subgroup of patients with lung inflammatory infiltrates at baseline (n=15 in probiotic and n=11 in placebo), decrease in infiltration correlated to higher interferon-beta (Spearman correlation=0.46, p-value=0.018) and especially lower CXCL13 (Spearman correlation=0.69, p<0.001), in agreement with the protective effect of lowering CXCL13 for reducing lung inflammation.

Viral clearance: All 70 subjects were positive for SARS-CoV2 at the beginning of the intervention by PCR analysis (see EXAMPLE 2). At the end of the 30-day intervention, 17 of 35 subjects (48.6%) in the probiotic group and 8 of 35 (22.9%) in the placebo group had achieved a complete viral remission by PCR analysis. Therefore, the effect of the probiotic was more than twice as high that of the placebo, this difference being statistically significant (Chi-squared test p-value=0.026).

Example 4: Serum Concentration Measurement of Plantaricin G 4.1. Methods

*L. plantarum* strains (CECT 30292, CECT 7483, CECT 7484, CECT 7485, CECT 7481, 299v and WCFS1) were grown in MRS broth at 37° C. Bacterial cells were collected at the exponential phase (OD62o~0.6) and at the stationary state (OD62o>1.5) by centrifugation.

Total RNA was isolated from pellets using RNeasy Mini Kit according to manufacturers' protocol. RNA was then converted to cDNA using NxGen Reverse Transcriptase Kit. Real-Time Quantitative Polymerase Chain Reaction (RT-qPCR) was performed using SYBRGreen on an AB17900 machine and Cycle Threshold (Ct) values were recorded. Data was normalized with the housekeeping gene RecA and expression of the WCSF1 type strain was used as reference to express gene expression using the delta-delta Ct method. RT-qPCR primers used in the experiments are indicated in Table 9.

TABLE 9

RT-qPCR primers used in the experiments.

| Gene | Forward Primer (5'-3') | Reverse Primer (5'-3') |
|---|---|---|
| plnG (target) | AAGTTGACGAGATGGACT (SEQ ID NO: 1) | GTAGTCCCTTCTAAACTCGT (SEQ ID NO: 2) |
| RecA (housekeeping) | GGCAGAACAGATCAAGGAAG G (SEQ ID NO: 3) | TATCCACTTCGGCACGCTTA SEQ ID NO: 4) |

4.2. Results

Figure 7:
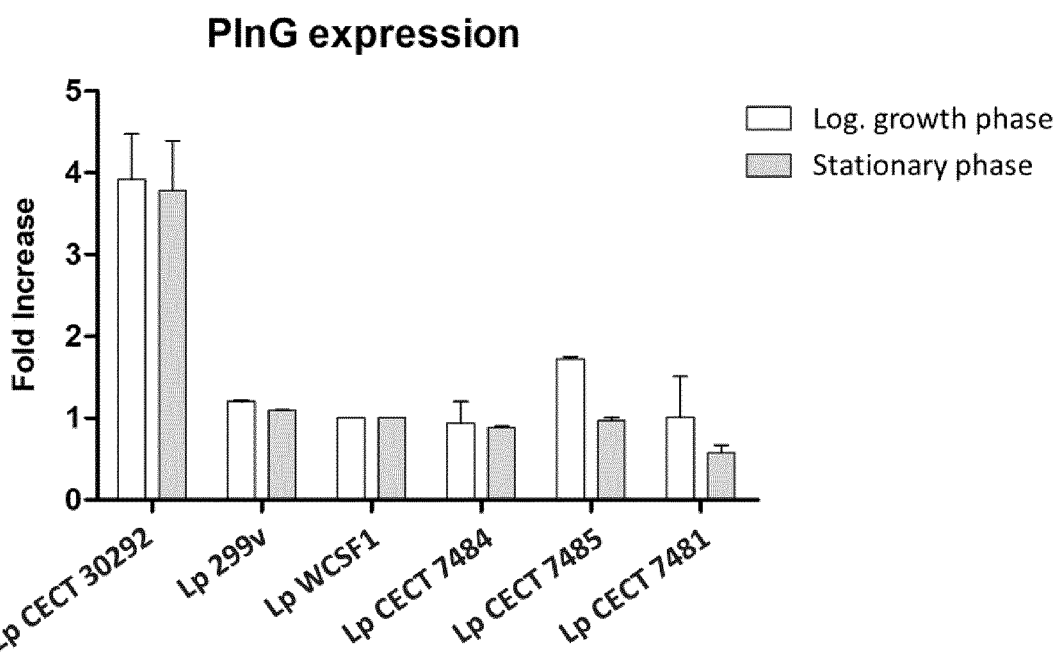
FIG. 7 shows the fold increase of the Plantaricin G (PlnG) protein of *L. plantarum* strains CECT 30292, CECT 7483, CECT 7484, CECT 7485, CECT 7481,299v and WCFS1. *L. plantarum* CECT 30292 significantly overexpresses the plnG gene in comparison to the strain type WCFS1 and also in comparison to all other tested strains. See working Example herein for further details.

RT-qPCR experiments revealed that *L. plantarum* CECT 30292 significantly overexpresses the plnG gene in comparison to the strain type WCFS1 (four-fold increase, p<0.001) and in comparison to all other tested strains (p<0.05). The effect is consistent both when the strain is in exponential growth phase and in stationary state (FIG. 7). Therefore, strain *L. plantarum* CECT 30292 has a higher potential to be sensed by immune cells than other *L. plantarum* strains.

Example 5: Intra-Strain Variability Assessment 5.1. Methods

To assess intra-strain variability, whole-genome sequencing was performed for two different batches of strain DSM 33765 using the same methods already described in EXAMPLE 1.

5.2. Results

The pairwise Average Nucleotide Identity (ANI) between the genomes of two different batches of the same strain (DSM 33765) was 99.99%. Considering the size of the genome of this strain is 3,322,082 base-pairs, this 0.01% difference amounts to up to around 330 nucleotide polymorphisms.

Example 6: PlnG Gene Copies 6.1. Methods

The sequence of the plantaricin G gene (plnG) was downloaded from the UniProt database (https://_www_.uniprot._org/uniprot/Q1WFD0, UniProtKB—Q1WFD0 (Q1WFD0_LACPN), Entry version 73, 29 Sep. 2021) and searched against the genomes of *L. plantarum* strains CECT 7484, CECT 7485, DSM 33765, as well as the reference strain WCSF1 (see EXAMPLE 1). Search was performed using the "tblastn" application from the BLAST program (https://blast.ncbi.nlm.nih.gov/Blast.cgi?PAGE_TYPE=BlastDocs&DOC_TYPE= Download).

6.2. Results

The bacterial chromosomes of the four *L. plantarum* strains analyzed contain one copy of the Plantaricin G (plnG) gene. Remarkably, strain DSM 33765 was the only strain to also contain plasmids carrying the plnG gene, as shown in Table 10 below. This could explain the markedly higher Plantaricin G expression achieved by this strain (EXAMPLE 4).

TABLE 10 plnG gene copies and plasmids with additional plnG gene copies of the analyzed strains.

| Strain | plnG gene copies in | Plasmids with additional plnG |
|---|---|---|
| CECT 7484 | 1 | None |
| CECT 7485 | 1 | None |
| DSM 33765 | 1 | Yes |
| WCSF1 | 1 | None |

REFERENCES https://clinicaltrials.gov/ct2/show/NCT04517422WO2011092261A1

Chong et al. *Lactobacillus plantarum* DR7 improved upper respiratory tract infections via enhancing immune and inflammatory parameters: A randomized, double-blind, placebo-controlled study. J. Dairy Sci. 2019. 102:4783-4797

Meijerink et al. Identification of Genetic Loci in *Lactobacillus plantarum* That Modulate the Immune Response of Dendritic Cells Using Comparative Genome Hybridization. PLoS One 2010. 5:e10632

D'Ettorre et al. Challenges in the Management of SARS-CoV2 Infection: The Role of Oral Bacteriotherapy as Complementary Therapeutic Strategy to Avoid the Progression of COVID-19. Front Med (Lausanne) 2020.:389

Hishiki et al. A Double-Blind, Randomized, Placebo-Controlled Trial of Heat-Killed *Pediococcus acidilactici* K15 for Prevention of Respiratory Tract Infections among Preschool Children. Nutrients 2020. 12(7):1989

Hill et al. The International Scientific Association for Probiotics and Prebiotics consensus statement on the scope and appropriate use of the term probiotic. Nat Rev Gastroenterol Hepatol 2014. 11:506-14

Channapannavar et al. IFN-I response timing relative to virus replication determines MERS coronavirus infection outcomes. J Clin Invest 2019; 129:3625-3639

Haagmans et al. Pegylated interferon-alpha protects type 1 pneumocytes against SARS coronavirus infection in macaques. Nat Med. 2004; 10290-3

Kleerebezem et al. Complete genome sequence of *Lactobacillus plantarum* WCFS1. Proc Natl Acad Sci USA. 2003. 100(4):1990-5

Darling et al. Mauve: multiple alignment of conserved genomic sequence with rearrangements. Genome Res 2004. 14(7): 1394-403

Jain et al. High throughput ANI analysis of 90K prokaryotic genomes reveals clear species boundaries Nat Commun. 2018 Nov. 30; 9(1):5114

Rodas et al. Polyphasic study of wine *Lactobacillus* strains: taxonomic implications. Int J Syst Evol Microbiol 2005. 55(Pt 1):197-207

Tanizawa et al. DFAST: a flexible prokaryotic genome annotation pipeline for faster genome publication. Bioinformatics 2018. 34(6):1037-1039

Shennan et al. CDD/SPARCLE: the conserved domain database in 2020. Nucleic Acids Res 2020. 48:D265-D8

Galata et al. PLSDB: a resource of complete bacterial plasmids. Nucleic Acids Res. 2019. 74:D195-D202

Alcock et al. CARD 2020: Antibiotic Resistome Surveillance with the Comprehensive Antibiotic Resistance Database. Nucleic Acids Research 2020. 48:D517-D525

Bortolaia et al. ResFinder 4.0 for predictions of phenotypes from genotypes. Journal of Antimicrobial Chemotherapy 2020. 75:3491-3500

WHO Working Group. A minimal common outcome measure set for COVID-19 clinical research. Lancet Infect Dis 2020. 20:e192-el97

Borghesi et al. Chest X-ray severity index as a predictor of in-hospital mortality in coronavirus disease 2019: A study of 302 patients from Italy. Int. J. Infect Dis 2020; 96:291-293

SEQUENCE LISTING (8 sequences)

SEQ ID NO: 1 - DNA, 18 bp, Artificial sequence
  PlnG gene Forward primer
aagttgacgagatggact

SEQ ID NO: 2 - DNA, 20 bp, Artificial sequence
  PlnG gene Reverse primer
gtagtcccttctaaactcgt

SEQ ID NO: 3 - DNA, 21 bp, Artificial sequence
  RecA gene Forward primer
ggcagaacagatcaaggaagg

SEQ ID NO: 4 - DNA, 20 bp, Artificial sequence
  RecA gene Reverse primer
tatccacttcggcacgctta

SEQ ID NO: 5 - DNA, 3237983 bp, Lactobacillus plantarum (residues 1-1,618,992 of 3,237,983)
aaaagttgttgacaagatattgattgagatgttatgatgattaagttgtgttaagcgattaacacatggaattagatctttgaaaactgaacaaagtttcgacgaatcaaatgtgtagggtctcttgattttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactggggaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaatattacggaaacctacacacgcgtcgaaactttgtttagttttgagagatttaactctcaaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagattgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtctggtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggtgcatatgaagatatttgatattagctagttttgagagcacaagtttctcaatagtgtggtgacgatggcgagaaggatacacctgttcccatgtcgaacacagaagttaagcttcttagcgccgagagtagttgggggatcgctccctgcgagggtaggacgttgccatgcaacctaaggaatcgttaattcggttcctttttttacgttgaatgtcaaccagtacagtttgaatttaaacatgcttttggtatactggatagggtcaattaacgccgttttagctcagcaggtagagcacttccatggtaaggaagaggtcggcagttcaaatctgctaaacggcttgctgttagaagatgattggcgtggaatgcttgtttaactgttttttctgcaactaatcatcacattagggtccatgtttaagattaagacttgaacgaaccaaacttaatatgaaaagaggtccacacgctcgcattagattagctaagcgagcgtgtggacctcttttgctatcaagaactgggagggcgagcttcaaccagtatataccccctgtgattgagcgtaacacttcattttgcagttttagaccgaacggcttaattatgttagctgctaggacgtggaagtatgcttgagattggctggccacgcggcttcaaattgcttgaataggggcattaatgattgtcgattgctaacaagataattgacatagattggcatgtgagcacgagtatcgctaatcgggatagcgactcgattgtcatcatcggcttggctatccagctggtgaggcgccaatgcggtaaagttagtactgaagtacggaaaatcagagtatttagtgatttctgtaaaggccgtgcgttggggttggtataagaatttagcatctgggatggcctgctgaataatatctttccaaataccgattgcgcttagaaccacgaagctaattcccttaagttcggcgaacgtgatgctaggttggttcgcacggtacatgaatcgctgtaaatggaccacgagattttcagtaccgatgaagcgagattcaatgccggccgtcagaatttcctgattagagaaaatgaaacttgcctggcggttaatgagatgctcagtgatttggtcgtcggcaatcagtggttgccttactcgcagcgaattaggtaataccgttttgagatgggtgagtaaggcaagtggaccaggtagggtggtttcgacggtacgtgtgactaagctttgctcgtagttttgtattttggttacaaaagtccgttgttgtgtcaataattgttcagcttcctgagcggctaactggccagtgggcgtcagtgtaattcgattgggttgacgatcaaataagcgaacagcgagcattgtttccaatttctgcatgccgcgagtgatagttggttgcgtcacgtttaatgcggccgcggtcttagccagcgtgtgctcgtgggcgaatgtgatcagctcttctaataaataattttcaatcatcaggaacctccgttactagtatgcactatatgtatactagtatgaataagcagtaattttcaagtattaggtttgcgggtatgcttgttattgtaatcaaatagtgaaaggttgatgcgtgatggttccaacaacgaaattaaacaatggtgtggttatgccccaattgggattcggcgtgttccaagtccctgacctgaatgaatgtgaagcagcggtgaccgcggccttaaaggctggttaccgtttaattgatacggcaacggcataccaaaatgaaaccgcagtggggcgggcaattcaaaagagtggtcttagacgtgatgaactctttgtcacttccaagctgtgggtctcagaattcacctatgaacgtgcaaagcaaggtattgatgcgtcattacaacgtttaggcgtagactacttggacttgtatcttttgcaccaaccttatggcgatgtgatgggtgcttggcgtgctttagaagaggcttaccatgctggtaagattcgcgcaattggtgtttccaatttttatgcggatcagctaaagaacttggaactgaccatgtccgtgcaaccagctgtcaatcaaatcgaggtcaatccatggtaccagcaagcagacgaggtccgctttaatcaagatgaacacgtacgggttgaagcttgggcaccgtttgcagaaggtaagcatgcgattttcagtaatccaagtattcaaactatcgcacaggcccatggtaagacgaccggacaagtcatcttacgttggctgttgcaacgcgggattacggtgattccaaaatcagtgcatcctgaacgtatggctgagaatatcgctgtttttgattttgaattaacagctgcagaaatgtcagcaatggccgaacttgatcagggcgtcagtcagttctttgatcatcgtgatcctgtgacaattgaacagatttttggcgctagtttacgacaattacatgaataagttaaggagtgattattaatgacaaaaacaccaactattacgctaaatgatggccgcgcgattccagcaattgggtttggcactttccagattccagacgacggttccacttatcaagcagtcaaagaagcattggcgattggttatcgacacattgacacagccgtggcctattttaacgaagacgaagttggtcaagctattaaggatagtgggattccacgggaccaaatctgggtgacgagtaaactttggctccaagactacggctttgacgcagccagtcgcgccatcgatcgttcgttaactaagttgcgactagactatattgacttgtacttaattcatcaaccttatggcgatgttccgggtgcatggcaagcaatggaagcagcccaaaaggccgggaaattaaagtcgatcggtgtttccaatatgacaccaacgttgtggcaaaaatttgtgccacaatttgaaacgatccctgcagtcaatcaggttgaatttaacccgtactttcagcaacaacccttgcgccaattactcgcggcacaagatgttaaattagaagcttgggcgcccttgggtcagggcaatcaagcattattcaaagaaccaatcattcaacaattggctattaagtatcataaggatgctggtcaaatcattcttagatttgaacatcaagaaggcgtgatcgtctttcctaaatcagtgcacagtgcacggatcaagagtaatcgggatatcttcgactttgaattaacttcgactgagatggcccaattacgagctttagataccggtaaaggtcaccacgacccagatgcgccaggggtttcagaacagttgttgcatgcctttgacgtgcatgcagatgactagcggcagagccggccaagtcgcggacgaacgtaccgtagtgtaagctgctttgattgtaactgaaaattaacgacgccatggacgctagaatcactagcgtccatggcgccgttttttgattaaggcctttaaaagccgtaacttgaaatggcgacgaataaaaatcagcttactaaaatggggcacgttacgactaatgccgaatgatgaagctgaggatggctggttattaatcgctggcgggaacctcattattgataatttgctcgttaaagtcagtgaagatgcctagcagggtcttcacccgttgcgggcccaattgagtcgtccactggtgaaccgttttgtgcatggtggccattagttgctgatctaggtgacggccggtagccgttaaggaaagtcctttttggcggcgatcagtggcattagcctgttgctcaatgtatcgatgtttgaggaggactccgatttggcgtgagattgcgctgcgtgagacatggtgctgatgtgcgatctccattaataatagtggctgggggctttgacctatttcatgcatgattaaaaaagcgtcaaaggtaagatgttgcgtggccagtagtgaatttaagcgagtattcaggtaacgagagatattggcataatcggtcaaaaacatgtcgagagcgtcgacggtagccataaataagaacctccttgaagagcgactgcttggtaaatttggattgactatattcactaagcatcataccgctaaacgtgtaaaaagtgtaagattgtgagccgcaaattagtgactgaaattctatgtgaacacgcatgcctactagcaacggttggtaatatcaaaaccaccgctgacagttttttgcgctgtcagcggtggcgaatagattatcgatcaacgttacaaaaaagtcagtgagtccgcaggcgtagagcgacgatgcgggcgtaaagatcggtgacgcactaagcggttttagtgcgatgacgacgagcaatcatcggcaaaatcatccctaaggcaacaaagataattggcgttagaatatttaaagtcagttggaagagccaactgctaggattgctagcgtaggaagtctttggaaccattccgaggatgcaagcaaatgctgtaaacaggaagcaccaagcaccgaccaaacggccagcgactgggtttttcaggaacttgtaatcactcttgaattcctttaagtgcttgttgagtagcatgtaagctagaaagacccacaggtagcgcatcggcattacgaccgaatttaagttcaataaccaattaaagagttcattcatgtttccaatccctaatgcaggaatgataatgagaatgctgaccaaaaccccagttaagatgtaaccgttgacgggcacatccttcttgttcattttacttaattttttgggaataaattcagggtcggcatcaccaagcaaaatcttcaatggcgcatcgattgagaacgctaaggcggagatttgggcaagcacattggcaattgcgtagaggatcaagaacagattgcccacgtggtagaaggcacctagtcgttgaaacgcgtagtaagcaccgttggccatcaaatcagcgggaatgtgcttggagttaaacagaatccccatggcaaatgaacccagcagggcacagattgcgaccatacctgcgagcactaacatgcctaacggaaactcacgtcccggatttttggttttattaacgtacggcgaaatcttttcagatcccccgaccgcgaagactaacattgaaacggtcgtaaagtaggtaaagtcaaacttaggtaagtaggacttgagtgaaaacatgttcggtgtctgaacagtcgccttggtcataaacggtgctgatacggccaagatgatgaataaaatcgacatgatgaacatccccgtaccagcaacgctcccgatgcgtttcagtgtcgttagtcccaatgaagcaatccagaggaagaataagaatagcactaaacaaatggcttgaacgactaacgcaggtgtcgtgttgacgaagttcccattaccgcggaacagccagctgaatgcaattagaatcccttggggtttttgtgctaagtacggaatgtgcacgatccaataagtccaggcagcatagtaagctaggcgcttggtactcgttgctcgaatccaagatgagacgcccccctcagcatccttaaaggtcgaacccagttgacccacaatcaaggtgtagggaataaaataaataatcatgatcaaaatccaagaagtgacgactgaaagcccttgtaacgcaaaattattgacaacgttacctaggccccagaccgccacgaatgcaattaaagcaatgttggaccatcgaagttgtttttcgttttccatgttgaactcctttgtgagctaaagtatgcttaattgtaaggccaaactgaaagcgatgccagtattaacaagttaatattaaaagcgctttaaattttaagtcaaaaaatgaattttgagtgtcaaaacagcgaaaatttgctattgttaagagtagataaaatttaacggcaacggacgcgcattgttcgaatgaaaatgaaagcaggaatggtcttgaaagaagttacagttggggagttaacgttagcgacagggatgcctaagattggtattgttttagcgggggccacacgggaggacctcttgcgtaaagcggggcagattttaacttcggtggcacaaattgttgtttggcggttagatccttatcaggaattggataaccgtgcggagttagtcaatacagcggcccaattgcaacaagttttggggacgattccattaattgccatgtttgggctggcaaacgatccagctgaagtgaccgaatattatcaaacttatcaaacattagtgaataatcgaagcgtggctggcgtggatattgacttagccatggtcaatcagccagattttatgacgttgaccaaacagatgcgtgccaacgaaattcggttaattgcgagccagaccgtcacgacagcaacaactgacgatttattgacgacttatcacgaattagcagcaactggtgctgatgtcgtgcgggtgacagtggctggacatgatgcacagacggtgttggcattaatggcggcaactgagcaagcacggcagcaattagttgtgccaatcgtggcaacggcgacgggcaagtttggtcgttataacagtgtctgtagtcagttgacggggtcggcagttgcctttggacacgtcggccgggtcggtgatcaaagtcaattagcagtgagtcaggtcaaacaggcgttacaaatgttggcaccacttgaaggggcgtgaaatcaatgcaatggcgatcgttttggcggcatacccggacgatttttgaaacgttagtcatctatttcttactgattcaagggccgtatgatttgtggatcggcaaggtgggctatcgacttagttcgtatttaattgatattgtgggtatcacggtgctgtttgtcatcgttgagctagtttataatgcgattcgacaaatcgttgtgaaacgacgatccaaatgactcggggccgagtgacaattatcgtatctactagctcatgattacgcggggggagtctttcgattcaaattagggaaatacgctattagaatgggtaaaccaggtcttgagcagtaatattgctcaaggcttttttgatggccggggattactggaagacactggtcagtcgccatggtgacagctgaccggtgcatgatgcaactgtcagtatggtgaacgaatagtggtggtcgaatactaaaacgaccagaattaatgaatcaccacgatgaaaacgattgcagaaatagggagttgataattatatttttgcgataaacaagcggattaatcataatgataacaggttaattagaattgtgataatcagttgagcattatgagggtaccatggtatatttaaaaaccgtaaatgatgtactagttaaacacgataatcaaatatagtaagaacactttatttaatgagattaatcgttaggtcagttaggttgtttttgaagaaatggggaattactatcaattaccgtgaatcagaagtgaaatgttataaaatgtataaaagtggcaagatgtggttgcttgcgagcgcttcactattattgttgaatactcaactgttaaccgcacatgcggatgaaccaacatctgcatcgactagcgaaacgagtgtcgtagcgactaacggtgtgtcaattcaaaatcaaggtagcagcaatcaaacactggcaagttcggtttctaaaacggataacgttgtcgtggctaatgatgagaacgcttcgattactaatcagacggtaatcgatgcacagccagctactaatgacgagccgcaatccgctgcatcaacggctgcgttgaacgggacatctggcgcgcccaatagtgaggtagccgctgattcgatggcagcagtgaacggactaaacacggtagcgcccgcgacgaacagttatgaagcatcacggactgacgatctgttcagtaatgccgcagaatcgactgttagtgaacaacagcctgaagcgagtgaacagttattactcgatactgctgacgcgtcagaacgtaaacccgccgctgacttgcaacatgttgagcagcatcagctggtagatgaccttaaggtggagtcacagcacgttgatactcgtgctgtgactagggcggatgaggatgaaatgtctggtaactttggcgttgattggcactttgatgccagtacaggcacgctaacgctgaacgggggaacgttaaataacagttatggggataatccttggcgtcgcaagtcttgggcgccgatgatcaagtgtatcgtgattgctgacaaaattgttgccggtactaacatgaatagtctgtttgcgaatcttgacagcgtgacgcgttacgaaggggtagaaaagattgataccagtgctgtgaccaacatgcagtctctgttcaaagaaaatacctcgctagagcgactggacttgagtgcttggcaagtcggcaatgtgaccacaatggtgaacatgtttatggggaacttcatgggtactgaacttaaataccttaatctcagtggctgggatactcataatgtcgccaacatgcaaaatatgttccagttcaacggccaacttcgaactattgacggtttgactgactgggagacgcgcagtgtgacgacgatggctaacatgtttgcgcgcacaggcgtccgtcacttgaatctgacgagctttgattcagccagcctggttgaaatcgatggtgcctttgcgcagatgtccgatttggagcatatcgaattcggtacgcagtttaccgtcgctaaagtcactcaaatcaatagtttgtttaatgatgatgccaaactaaaggtgctcgacttgtcccatttcaatatgcagagtgttgaacaaaactggcaaatgctagctggtttgacaagtttgcaaacgttgacacttggtccgggacttgattttagtcaacacggcacgcaacccttagttgatttaccggaagtgcctaagaatagcaaatataccggcaaatgggtcaacgtagctgatagctcgcaaacgtttacgagtgctgaactcctggcgcaatattcgggaaaccacgctgacacggcgacgtttgtctgggaaaccgtctctgcggccgcgattaccggtaaagacagcacgctcttcttgaatcaaaaatgggactggacacaaaatattgcgcaactagttgatcaaaatggccagttagttgatccaggagtcttgttcagtacagacccccaagcggtgacagttagcggtgagcctgttgacaccagccggccagggtcgtatcacgtgatactaacttatgcgggtcggcaaacaaacgtggttgtcacggttgtggctaatcaaagtcaactaaatttgcatgcgcaagaagttgcggttgaaattgatcccgcaacgggaagcgctgtctggcgcccacgggataattttgcgagtgcaacggatgcagatggccgttcagtggaatggcagaacgtgacggtgcttggagaaccagacttaacacggccggggacatatgaggtcgtttatcagttcactgacttgaccggacagttagtcacggcgacaacgaccgtcacggtgactgaacaagaggctgacgttgaagacctgacagaactggttgttcaagatacaacggtgacagttggcgaccactggcaggcggcagacaacttcgtaagtgccagtgatgcgacgggacggccattaacactagcggacttagttgtgattggtgacgttgacacgacgcaacccggtacttatgaaatcacgtatcaatacacgaacgccaatggcctgcagtggactcaaacagccaccattacggtagtcgaaggtgctggcaatggtgaaacgccgttaccgggagaaccagctgaaccggagttaccggaagaaccaggaacacccgaacagcctgaaacccctgaaacccctgaaacccccgaaacaccaggggaaccgtcagcgccagggacacctgatcaaccagaactgccggaagttcctgaacaatcagaacaaccgggaactactgaacaccctgatactagtgatcctaacagtggtttaacgggcgcaaacgctggttccagcagtcaaagggagcaagcagacacgatagtgcgaccagaatttaacggtggtttagagaagcaagtgaccacggtgtttcgtgataacttgaaactgaatacggctgaacgcaatgaggacggaattgatgctaaacgttatgctaaggctgatacagctaaaccggaagtgactatggccccagtcagccatccagcgtcagtagctggtgagctaccgcaaactagcgaacaagttaatcgcttcgggttgctgggactcatgatgttaatggtgactggtttagccagcatcgtcggcattaaacgtcggcaaggttaattaataaaggagtgagaaattaatggaacaagtgaagaaacggtacaatatgtacaagagtggtaaggtgtggttgttcgctggaatcacgctcgttacgttgaacatgaatgtggtgacgggacgagcagatgaatcaacacacgtagaagcattgactgaaccggcagtggcaactttgtctgaaggtaacgctgagcagcaatccccagtaacggacgccatggatgaatccgcaatgagtgaactggtaactgaagctcaaccaattaaagtgcaggccgctgaagaacagtatactgatgagattgtcaatcaatctgatgatgagcatgcgaattctgatcaggtcagtgtaccggtcacggatcaagttgacagtgagacccccgttccgtcagacgaacatactgcaacacttgatacgcatccgaaccaatcgacaactgatgattctgaacagccagttagtgccgacgagcagtcgcaagatattgacacggatagtactgcaaaagtcttgtcgtcgcagcataaaacggaaaccatcaatgagcggggaagcggtgatttggctggcgtgattcgaaatccagaacgcccacatctcacggatggttatcgcaacgatgatatggaagacgatgactcgatggccggcatctggggtgctggttacaacgccgatggcattaaatggcattttgacgcggattctggtgtgttagtgttggacggtggcgatatttacgattgctatggggatagtccgtggcaatcaaaatcgtgggtgttacaaatagttaaagttgtgatttcaaagccaattcgcattataggtgatagtgggggcttctttgaaaatttgacgaatgttgaacactatgaagggcttgaaaaaattgatgttagttctgcgacggatttaagatatttcttttcagaaaatacgcatgttaaggagctagatttgagcagctggcaggtgagaaatgtgactgatatgtcttacctgtttttcaattctccagggactagccaactaacgacaatcaatatttcagggtgggacactcgtcgagtaagtgaagcggactacatgtttggtcccaatgaaaagttaactcgtattattggtatcgagaatttgaactttgaaagcctaaaagaagcaggcggtttgtttatcaaaacggggttgtcggagctagacttatccaaatggaagactgatagccttgacaatatggctgcttggtttatggacatgcacaacttaaccagtgttaaattcgggtctcagttcaaaacagatcaggttacttggattcatttgctattttcaggatgttccaatttaactgaggtggatctatctggttttaatttgcatcgcgttgaacaaaatctcgacatgtttgcgggatgtgagcgtctacaaaaaattacacttggtccggatactgatttgacgccagccaaaatcgagtcggttgggctaatggacattgaagctaatgaccaatataccggttactggataaatgtagccaatccccagcaacggttaactagtgctgaactgatgaatctgtattcaggaaaaaatacgccgattggaacctacatctgggaagcaaaccaagcagttatcgatgccaacgacattaccctggaagttggcgatgattggaactggacggacagtattgagagtttaaccgaccaatttggtcaaaaagtcgatgttcaggccctctatgtggctaatccccaggctgtgaaactatcgggtgaccgagtaaatacaagtcagccgggtacttaccaggtcactttcaagtatgcaggtaagacggtcactgctttggtgatcgtgaaagctgaccagacaagtttgactgtccatgatacagagttacacgctggtggcacttggcatgcgcaggacggttttgacggggcgacggataaagacggtcacgccatcgactttaacgatgtgacgataacaggtgaagtgaacaccatggttccgggtgattaccagattacttacacgtatggtagtcagacgcagacgattactgtaactgttaaggaaaaccaagccagtttgaacttatatcaaaaccacgcaacggtgcatacggatgggcagggaaccagtacttggcagccccaaagcaattttcagaatgccactgatagtgatggtcaaacgttagactggtcggccattgaggtcgttggaacgccagattggactacagccggggactatcggttgacgtatcaatttactgacaagactggtcagttggtgacggcaacgatgacggtaacggtggttatcgaggaggccgacgaacaggcggaatcccaaagcgatttacagattcatgattcaactattactgtcggtgagtcgtggcaaccaagcgataatttagtcttggctacggatgttaatggcggtgaattgtcgcttgctgacctagtcgtaactggcacggtcgatactaatcaagccggtgtttaccaggtgacttatcagtatacggatgcgagtggtcaagttttcactcgcgtggcaacagtcacggtcgttgcggcgagcgatggcgatacgaatactgaacagccaggcgctaccaataccaatgaagatgtgaacggcggctcgactggaagtatcgatggtgatgatcaagcagaaatacctacggatgatgctgaccagatggagggtgatgcggctgacgttgatgcaaatgcagttattgatgacgcaacacccgcggttggcacgaatcatggaaagggtgcggatcgtaattctggcatgcaaacgacggctaatggggctaaatcagtagtcacttcatggccgcatcggagccagacgttcaacacagttagttcacaacacgcgcaaactatcgttgccggtcatcatcaagaatcacggccgactgaatcagcttcggtagctgttcagcccgcaacggccaaactcggcacatcggctttaccgcaaactggtgaagcgccaagtcgtgcaaatgtgatgggaacagtgctattggggttgaccatgttcggtagttggctcggatttcggcgtgtgaaacgccattaaacaacgtgctcgaaatcgtaaggactgaataaaagtgattacggtgattgtgattttcggtatcagcgtcgggatgatgtgtcgataacagttaataaaagaaacgcttcaagaattagtcatgaattcttgaagcgtttctttgttattcactcaatcaaactagtcaggttactgaactttagcaacgagttgttcagtaaatgcatccagggcttttacatcatcagcttctggtgcaaggttaacgaacacgtccttggcaccctgagtagctccagccttctttaacgcgttactgaaatcgatgacggcacggcaataatcatcatcatagaaagtatcgccagagccggcacagccgtaaatcttaccggttaaatccaaatcctgtaagtcctcgtagaagtcgagtccctcttcagggagggcgccctcatcgtaggtgtaagggacgacaacacaaatatcaacatcgttgaattcagttgcgtcggcttgcgagatttcttctttggcaacatcgaccccaagtttttcgaatttttcagtaataatatcggcaacgtcttcgttgttaccggtaatggtagcaaaaataactttcgcagtagccatatgaactcctcgctttcaaatatcttgataagccgattatagcagagttttaaccttaatttaaggtattgggcagttattcacaaatccgcttgaccagtggtttctcagtagccaattccatgctataatttaactattaatggttattttaccgaaattgataaaaatttttggtcggcgcttaaccaggaatctcatgtaaattataaattggcgaggagcgttggttttgtctagaaaaaataaaaaagaaggattgggtagacggctctggaattcgattactgagccaattcccgacgatgatagtactgaacaagataatgaacagatccccttggcctatgatctgaaagactcggccgcatcaaaggcggacgaagccgaagcaaaatcaacggtcaatattccccgctcgacggcgaataacagtgccgaaaagcaacctgttgacgcagtaattgaaccagaaaaggtggctaaaaaagcgcgccattccggagacgatcgccaggctgtaaaacaatcggcggcacccgtcaagcatggggcgactagtgcggttaagcaaaaaggctcggctggttctcagtcgtcgtcaaaggcggaatccgcgcaaataactaaaaagtccgccgcaactaaaccggcctcaacagcaagtcaggcggcgccaaagacggccagcgcggtctcatcacaggcagtaagtgaccagcgttccaagcacgcagcttcgacgacagctagtgcggctcaatcggcaccagcgcgggccgctaaggaagcgtcacaagcaaccagcaccgcagtgtctgatcagaagcgtgtggctaaaacaacagcaagtaccaaggttcatcagtcggcggcaacgtcggaagttccaatgacgcggatggcccggcgtgctagtcaggaagctgccagtcaggccaagacgcacagtcaacagtctagtgcttcgacatcgagtgccgcggccgccgcatctgcggtagcacaatccacggccccgaagtccacagcccccaagtcagcgacatcaaaggctgctgtatctcaggccacggccacaaccgctaaggatccgcaagcgactgctgctaaacagccgaaggtcgaaaggcgcatcccagctgatcatattccaccggttgctcgtaaacagcaaccgcggattgcggtcaaggggacggaacaagcggatgatgacacgcagcctgagttaccattatcacgtgaagagttgtatggtgatcagcagcccaacggtggcaagcagcccaataagccaaccatgtcacgggtcgctcggcacgaagaacagcgggtaccacatgatgatcagccggatgacgaccgtgacttttctgagttagaaacggatgaaaagaatccacatcttaagaagccagctcggcgctataactggaagttgatgttggctggtgttgcgattctggttgttgctgctggtggagctttcttcatgtggaaccatgggcaagccactcaagctgcggcacgaaccaatgcggaaaagatcgtggaccaagtttatacatcatcagcccaacgggacttgcgggcgagtgcctcaagctcgactttgaccaagttgcaaaataatattgataatatgaaggattcaagtgaaaagacccgtttgcagaaacagcatgatacggctgctaagatgttgacggtccggactagttaccaagatttacgcaacgctaaggggttacttaagaccgacgtgaccatggacaccattactaagggtcagcaacggttgacaactgctggcttaacgactagtaagccgtactttgctaagaagtatgataagttgtttacgacaacgggaaaaacggttaagaaagtggtcagctatgatgctgatttccaaaaattatataacaagaaaaataagctcaaggcttcgaccccgtcaacgacagtcgataaagtacttgcaaacctgaaagcttatcgcaaaaagtcgcagttagcggccaatgattaccagaagttgattacggatcgcaagaagttggcgaaagcgaataacgcatcgtcttcagcctcaagttcgagcacgtatagctatagtgaaccagaatcatcgtcgagttcatcatattcgacttatagtgaaagtagtgacaacagtagttcggcttcaacgcatagttatagcaacgatacggacacgagctcggcaacgtcgagctcaagtacgcctagctacagttatagtgcaaacaccgatagtagctcaacgacgaattatggagatacgtcttcaacaacgaccggtggcactgcttcttctacagatggttatagtacggcaacgggcaataattaatttttctgggtaaacaagaccagtaaacttgatgatcgtctgaaaatttaaaaaccggccagcttaattaattcataattaagttggtcggtttttggtcgttagtgactgatcgactcgtgtcaataacctgggaagcgtgcaggcaggtgaatatccgagctggttagccattagttccactaattgttaccattcaaggagtgtccattatctggggcgaatgacgaccggtttgcggtaactggcagacacaaaagtgatgtaaacgggacatcaatgttagaatgtaaatataaaattaattataaagtgagagaggcgtgttttgatatggaaatcacaatttttggtaagggcaacatggggcaagcaattggtcataattttgaaatcgctgggcacgaggtcacttattatggttccaaggaccaagccacaacgctcggtgaaatcgtgatcatggcggtaccttatcccgctttagctgcgctggctaaacagtacgcgactcagttgaagggcaaaatcgtcgttgatatcacgaaccccttgaattttgacacgtgggatgacttggttgttccagctgatagttcggctgcccaagaattacagcagcaactaccagatagtcaggtgctcaaggctttcaatacgacttttgcggcgacgcttcagagtgggcaggtcaatggtaaggaaccaacaaccgtgttagttgctggtaatgacgatagcgccaagcaacgcttcacccgcgccttggctgacagtccgttagaagtgaaggatgcaggtaagttaaagcgggcccgtgagcttgaagcgatggggtttatgcaaatgacattagcagccagtgaacaaatcggctggaccggtggctttgcggttgttaaataattggtcaacgattaaacccaattaggttagttaccgattggcgatgctcgggagtgcgactttcgaacatcgcttttttgttggtattttgtgagccgtttgtcagcagtagcgtcaaacattgtgatttaaaccaaactgtgggctaaaaaagggtcagcctaacttactggccaatcttagctaatatccggttgtggatcattacggttcaagtgaatgatagtggtatgataaaagtattgatcaagaaattagaaatggggtaataagttatgccaatggtattgatggctcaagcaaccaaacctgaacagctgcaacagttacaaaccacttatccggactggacgttcaaggatgcggcggcggtcacggcggccgattacgaccaaattgaagtcatgtatggtaatcatccgttattaaagacgatcctagcgcggccaaccaatcagttaaagtttgtacaggtcatttcagctggcgtcgattatttgccattaaaggcattgcaagcggccggggtggtggttgcgaacacgagtggtattcacgccgatgcgattagtgaatcggtcttagccgcgatgttaagcgtagtccgggggtaccatgcggcctggctgaatcagcgcggggcacggcaatgggccttgccaatgacgacatctaccttgaccgggcaacagttgttgatatatggcacgggccaaattgggcaatcgttagcggctaaggctagtgcgttaggcatgcacgtgattggggtcaatacgaccggtcaccccgctgatcattttcatgaaacagtggcatttaccgcgacggctgacgcgttagcaacggctaactttattgtcaacgctttgccattaacgccaacaacgcatcatttgtttagtactgaattatttcagcagaccaaacagcaaccgatgttgattaatattgggcgtggtccggcggttgatactacagcgttaatgaccgccctggatcatcatcaactcagtatggcagcgttggacgttactgaaccagagccattaccgacggaccacccgttgtggcaacgagatgacgtgctgattacgccacatatttcaggtcaaattgcccactttcgggcgaccgtttttccaatctttgcggcgaactttgcacagtttgtcaaagatggcacgctggtacgtaaccaagtggatctgaatcgtggttattaattgaatatatgtaacggtagcggcaatgtaaaagccggttgtgactaggacttagtcacaaccggcttttactggtttcataattatgagtcatcgtttatggttgcttgaaattctctgccgtgcgatcattgggaccctgcccaatagccaaaataaagacggtactaataatcaggacactgcccagaatgtcgagccaaccgaagctgacaccgagtagaaccaccgcaatgatggttgcggataaaggttcaaaagcgtctagtagactgacaacggttggccggatatattgcaaactttgcaagaagaataggaaagctaacaatgttccaaacagcacaacaaaggtcaacttgctgatattaagcatagtcagtggaatatggattgaccagactggctgaacgatgttaaacaagataccccctaacaacattgaccaggtgttgacggtcattgggtcgtacttagtaagtagtttggttggtagcaaggtattcgtagcggacgagacccccgataagagtccccagatcaacgcccagacggagatgactagggtctgagggttgccgtgagtcacgagcaagaatgagcccagtagtgcacaaataattgcaaggccttctgcacgggtcggcaattgccgatgagcgactagcatccacagagcaatgaacacgggtcccatgaattgtagaattgttccggtcgccgcgttactagcttcaactgctaaaaagtaggtgaactgaaccggcattagacccaatagtgtgtaggccacgatctgtaggagatcgcggggttgacgccaaatcgaccacaaatcaacatgggtcagcaaactgaccagtaatagtgcgattccggcacccagcatgcgaattcccgttaaccaaatagaattaatatcggtcgtatcaaaaagtgtttgtgcgacggctccggaaatcccccagaaggtcgcactgatactagcaagaaagatacctttgaattcccgactgacttgcacagcaaaccgcctcctcagtaaaatcaacttaacctccattgtacatgattttgctgagaaaaggggaatcggttacgcacttgcttgttgactagcctgttcggtcgcgttctgagcattttgttcagtagtgtgttcagttgtggcactggtttggcgggtggtttcggctaagtgaaccagatgggtcagaaacgcgtgcgtttttgcttggtaatggtacttttggccgagcttgacgaggtagccattgatatagtcgacttcagttggccgattatgagacatatcttgatacatcgatgggtagtggaggggattagccactttgctgacgtagttgacagaggcgagctcttccgcgcgggtattcaacatggtgacaccatcacgctcacagacatcataggcttcatcgatcaattgacgactcagctcatcagcccctggataggccgcgaattcgcccatcgtaatttcaaagagggtacagagggtgttgaccactgagttgaagacgactttagccagcaaggtgccgcggaagttcgttgttaaattagggtggaattggcatttatctaattctgtcacgattcggtgggtcatttcgtcagggtgttccgtataattggcgagattcatggtgccggcgccgcgagctccaatgaagtcgacatcaccagggccgtttaagaccgtagcgactagtgcggtcccagctaataatttttcgggtttgaagtagtgtaataatttttcaacgtgacccatcccattcatgcaagtgagcacgtactggcgaccattaaaagcgtgggccgtccgagtcaaaaaatcagcaagttgcatctgtttagtaaatacgacccacacgtcgggatcatcgtgataatcttcgggagttgagactttgacgggaactaagtgtcgattctggtgatcgcgcgacacgtagacgccaccttgacgatgaatttgatcaacatttgcttgccaagtatccacaaaatcaacttgattgcctgcttcttgtaataacacaccgtaacgtaatcccatggcgcctgcgccgagtactgtaaaatgcatatgtatgaccatcctttaaaatgatttattaataaatgaaaataaaaacgtccgacagacgaagtcgtctgccggacgcgagcgcgggttaccaccggtattcatcagcaatttacattactgaccttaagcacatcatgaaagatgtactacacgttagtgggtgttaaccagtacgggttacttgatttcacccatacaactcacagtcgatattcgtgataccggattaggtctgctcacaccatctcagactcgctaaggctaacgaccggcaactactgaactgttcaatgctttttatcatcatttattaattgttctctaatttagcggctagactggtgaatgtcaagtagtgagattgaattctttggtatataaagctgatgagggcaaataatgctctaaatagcttctaaacttaagattgtttagccttacgtggtgaaaatgcggtggctagttcggttttgaaagcgatttccattataggagggaatagcgtacaattgggagtgtaaataagccttgtgctaattatgattgctaaaaaaggcggcggtgcgtcatctttttaatttaagcccattcaagtccggccaaccggcttactcatcagtgcggatacgccaatttgcgtatttactgacgatggcaggatggtaccgactgattggcaaacccagcaaaagcagtcaagctgaatgtcacagatgatcagttagctagcacaacatataggtaaatacgtaggaggagttcaactatgccaaaatatttagtctttatggacattgacggaacattattaacggatcaccaatatgtctcggagcgaactcgagcgacgattgaacggtttcagaagcaggacgtgttattttacatcgctacggggcgcatgtacgaactggcgaagattgttcgagacaaagtaaacgctgacgttcgtttggtgacgtctaacggggcggtgttcgatggtgcccagggccgtgagctaaccaaactcgggggtgctgcggttgagcttgcctatctgattgcacgtcgtgataacttaccaatgatgttgttcacgccagacatggcctactatacggaacaaatcccacggttcgttgctcgtaatgcggctaactttgatgcggatgaagtctcgattggctatgaagaagtgaagagctttacgcaattagccacgattgaggaccagattacgaacggcgtcattctcagtcgtgaagacatgtcacggctggattctgcccgcgaaaagctcactaatagtaaattgttgcgactttcatcatcgaacccgaataatattgagatgattcctctgaatacggataaggggacggcggtcaaacaaattcaacgtgagcaacatgtcgatgccgcccacacgtttgtctttggggatggtttgaatgacgttgggatgatggcagaagctgacttatcggtggcaatgggcaacgccttgccacaagttaagaaagttgcgaactatgtaactgatatgaattataatgatggtttggcactattcttagaaaaatactttgcggcccacccattatcaacgactaagtaaggtcagcttacaagcgtatcggtgtatcgacgaggacaataaggccattaaaaaagcgattctcacgtgtgtgggaatcgcttttgtggtattattaaaatttcgctatgacttaagtggtggtaattgacttttacgtcaaatttggcacacttagtattgaagtgtttttaggaagtgataactgttgaaaattgaaatcttaccgacgactaccacggaaattccactagcaattttgtcgatgagcaatcttgataaccgtgagttgaatccagcaattgaaaaacaattagctgcacaagggcttgccgttgctcagccgcagaatgctttggcagacttgcttcaagtgattcacgcgcgccatccagtgcagatcaatgcgtgggatatgaatacgcttggcactgagcaggttcagcttcatttaacggcacaaggggccagtctttcagcggatgctaccaccccaatcaggcctaatttggatagtaaaagcagtcgcattttaattgtagttggcgatccagatgcaagtgaagcttcagtgcatgcaactggtcaagaattacaacgcaaaatcaaagccttttttggtattcaggcgcgcttgcaatttccgagttgtaccacgcaacctgttagcatcgagacaactaggcccgcttcttaggggtgatattaatgtcgatcaacttgaattgccgattttggtagtccacgcgactaacacttgtatttttcaggagtcgggtgggaagctcacgggggctgatttggtataggaatgcactgagaaccagcccgtgagaaacgataagaatattcttgtcatgctgactatcctgagattcatacaaacagattcgtcgtagcgcgctactgattcgatccgtgacaccgaccaaagtctcggcgccacgagtctggtcgagggagttaaagacccatagtagggtggcgaagcgttcacgactcaacatcaacttaacaaacgttccaatgcccaattgtttttggacttgcttgacgatccacatgtttctggtaccttcaagcccaccgaagttaaattcgcgtaagccgacgtcaatcgtcggcttttttatttcaggatggagtgcggtgataatgcgactcgtttgttgtgctcggcccaagtcactgacgtaagcagcgtcgaaatgaacatctgctagcatgcgggctaaccgttgagcggagcgcacaccggtatgtgtgagttccgaatcatagatgccttgtaaacggccggccgcgttgagcttggtttgtccatgacggactaagtataagtgaatcgtagccatcgctaaccctcccatcaaattaattaatatagtccaattgtaaagcgttactcgtcattcaacaagtctttaattgttaattgccactttattttgtcgctgatatcaaaaagagcttgagcagctagcttgtttcgcgccacggtcggtttaatcggcggcgaaagcgcatttgagactgcgagtggatggctactagcctcgaataattgcgcatcttctggtcatcgtagccgattatgctaggtatcaaaaaatcccctaaagggtgatagctatttcagctaccgacctttaggggcgatggcaacgtaacgttgctactgattattccaatcttcgttcaaaacttgcttgttttcctgcttgagaatcttcatcatcttacgacgagcggtgaagaatggaattccaatgtgagcaaggttgcttcgaaaacgccaacggtaatggtaagtccggtccggtacgtattcggaggactgtacgtagttagcgtaacgaaaggcaaacaactggtcttcaagaaaatcaatatcttcgttgaacttgaggtggtgcgtggtaataatactgcgaatgaatgctttattccacgaaaaaccgccaaccgtgccaaagttgatgttggcaatcaagtctttttggttgtatgttttggcaggactcggaacggctaagtaaccgtagtgaccgcatacaacgagctgggtatcgggtgctgaccggtaggcggctaggaaggttgccagaaagtctggttcgacccaatcgtcgccatcgacaaagcaaaggtacttacccttagcagcagccataccggagttacgagctgcggagacgccccggttatgggcgtgagtgatcacgtggaaccggtcgtcgcctttgattaacgcggcaatctgttcaccagtgtcatcagtcgaacaatcatcaaccacgaagacttcaaagtctgtcaaggtttggcgttgtagactagtcaagcagctatctataaatttgtgctggttgtaagctggtacaaccactgaaaaaaggggtgctgacacgctaattcctccatcgtaaatttggatactgttactagtatacccataaattgtgatgaaattatagtgaatcgtctttttttagccataaattaattatttgcaagatttgtcgtatgaaaatacaatgcgaggtcgggataaacaaagatggtgtgagaaaaatctagtaagccattattcttataatagttacaagaatccaaggccaagtgagttgcgccctgtgccaaattcattagttcggcctcttccttgttaagattggtgagtgaaagataatcatcactgttagcaatcccgatgccgtaagcttcgttgatgaagtcccaaattgacgtattgacagcttcggtcgatagataggggacgacagagcgtaagtagtaggccttttccaaacaatacagttggtcgtgccagtagcggaggcgaatgatacgatacagttcttcgtcgacgggaatgttgagtttgcggctcagggcactatcgccgtggatcgtatcaaaagtcagaatcttcgaagttaaagtccgtgggtggacatgactattgaagagtgagcgtgctgacagattcactaccgttttatgttgaagctgaatattagtaatataatagccactgccttgaacccgacgcaggagcccctgctggtacaccaagtcaatcgctttgcgaatggtgttgcggctagcttggtaacgttccattaattgggcttccgtggggagtttgacggtaaaaatgccgtcttgaatggcggcaacgagtttggttgcaatgtcacgatacatggtgttcacttctttcgaatattaagttgttatttaataatttgtgggtacaaatcaaataaattgcagatatctgattaataaggcttgtcaaatttgtacccatgacttataattctaattgtaatgaaagcggtttattaaagcaaccgctgtaacatataaatttaaaacaatctaggagcgtgtttattatggctgaaagaacaattatgttggtatgtgccgctgggatgtcaacgtcattattagtctcaaagatgcaaaaggctgcggaagcagaaggcattgatgcagatatttttgcaaccgctgccagtgatgctgatgcgaagttagctgaaaagaatcctgacattttaatgcttggaccacaagtttgttatatgttaagtgatttccaaaagcgcgttgatattccagttgaagttatcaacatgcaagactacggcatgatgaacggcgaaaaagttttaaaggaagccgaagcatcaattgcaaaagcaaactaatcattaaattgtaagtgctaccagcccacggtagatcaatcgcggccggtggcattttgattgtgatgcacacgaataaatgctaaaaggatgagggtaaatggcagaagaacaaacaaaagaagttgaagcaagtctcgaaaccattatgggtttgatcgttaatggtggtaatgcaaagagttccgctttcgaagcaattaaagctgctaaggaaggcgactttgaaaccgctgatgccaagttaaaggaagcagataactttctaaccgaagcacacaattcacaaacctcaatgttaacggcggaagcacaaggggaacatacccacgtgtcattgttattagtacattcacaagatcacatcatgaatgccatcaccttccgcgacttagctggtgaagttgtagacgtttatcggcgtttagttgccgatgaggcgaagtagttaattaatttgagcctaggcaaatacctgctggtgttggtctgggcttgttttttcattcatgccgtggtcgcttataatggcagacagcttaacaacggtgacgtggcggttacacgcttttcgttagttaaggtaacaaagactgtaactcagggatagcctgagcagcattaatggagggaattagttcatgacaaaaggatacaaaatgcccaaagattttctgtggggtggcgcggtcgcggcccatcaattagaaggcgcttgggatgttgatggcaagggcgttagcattgccgatgtaatgacagccggacgtaacggggttccccgtaaagtcacggatggcgtcaaagatggtgaaatctatcctaatcactggggcaatgatttttatcatcgctatccagaagatgatcgattatttgaagaaatgggctttaagtgtttccggacgtcaatcgcgtggacccggattttcccgaatggtgacgagagcgagcctaacgaagctggtttgaagttttacgatgacttattcgatgatttattatcgcatggcatccaacccgttgtgaccctgtcacactttgaaattccataccacttagtgaaggtttatggtggtttcagcaaccgtaagatgatcgacttctttgttcattttgcgaagactgtcttcaagcgctatcaggataaggtcaagtattggatgaccttcaacgaaatcaataaccaaacagcttggagtgatccgcacccattgttacaaaattccggcctacaacttagcaaggatgacaattgggaacaggcgatgtatcaagcagctcattatgaattagtagcgagtgccctagctgtgcaagcgggccacgcaatcaatcctgattttcaaatcggctgtatggtcgcgatgtgtccaatctatccgttaacagctaaaccagcggatgtgatgatggcagaacgggccatgcaaaaacggtattggttcggggatgtccactgtctcggtgaatatccaaagtggttaccgaagtactttgaacgcaagggcttcgatatggatattaccgctgctgacttggcaactttaaaggctggtacggtggattacgttggtttcagttattacatgtcatttgttacaaagggtcgtgacggtgacagtgattacgatttcaaggaacccgatgactttgttgagaacccctacgttgagaagtctgattggggctggcaaattgatccaactgggttgcgctatgcgatgaactggatgcaagatcggtggcacttaccacaattcattgttgaaaatggctttggtgcttacgataagaaggaagccgacgggagtgtacatgacgactaccggatcagttacttccgtgatcacatcttggcgatggaacaagcggtcgtattagatggtgttgatctgattggctatacaccgtggggctgtattgatttggtctcagcaagtactggtgaaatggcgaaacggtatggattcatttatgttgacgccgatgataatggtcaaggcagttttgaccgttctaagaaagactcctttaactggttccaacaagttattgcgagtgatggtaaagatttatagtgaaaggatgataatgcatggcaacaacgagtggtttacgatctgatttcttatggggtggggcggtcgcagcccatcaactagaaggcggctggcaagctggtggcaaaggggtcagtgtggctgatgtcatgactgccggtgccaacggtgttcctcgtgaaatcacggatggtgtgattgcgggtaagaattacccgaaccatgaaggcatcgacttttatggtcactataaggaagatatcaagctatttgctgagatgggcttcaagtgttttcggacatcgatcgcctggacgcggatttttccaaatggtgatgaagaagaacccaatgaagcgggtttgaagttctatgatgatatgttcgatacttgccggcaatatggtatcgaaccagtgatcacgctggcccactttgaaatgccgtaccacttagttaaggaatatggtggctggcgttcgcggaaagtcattgactttttcgtgcactacgctgaaacggtcttcaaacgctataagaacaaggttaagtactggatgaccttcaacgaaattaataatcagacgacttatacgaaccaattcctgatggcgacggattctggtttagtgttgaagcccgatgatcctgacgctgaagctttgatgtatcaagctgctcattatgaagtcgttgccagtgcgctagccgttaagattggccatgccattaatcccgacttccagattggcaatatgatcaacatgacaccgatttatcctgcaactgctaagccacaagatatcatgcaagctgaaaaggctatgcagcggcgttattggtttgcagacgtacagtcatggggctattatccaaataatatggaagcttacttcaaacagactggtttccgccctgatatcacggccgaagaccgccaagtcttgaaggaaggcaccgttgattatattggctttagttactataattccaacacggtcgccgctcaggatgataacctaagttaccactttatcgggaccgaagccgttgataatccatatttgaagacgagcgaatgggactggccaatcgatccagaaggtttgcggtattctttgaattggttacaagaccgctatcacaagccaatgatgattgttgagaatgggttgggtgcccgcgacaaagtcgaagccgatggtagtattcatgatccttaccggattgactatttacgcgctcatatcagtgaaatgatcaaggccgtcaccgaagatggggtcgacttgattggctatacgccgtgggggtgtatcgatttggtctcagctggaactggtcagatgtcgaaacgttacggttttatctacgtcgacaaggacgatgaaggtaacgggacactagagcgctcgaagaaagattcgttctactggtatcaaaaagtgattcggacgaatggggccgatttgaagtaggaaactcgttgtgctagaagactactgaatgattatgcagttcgaacgacgattattagtcaattaataaccactaattgaagacgacgttcaaagtgagtgaactttgaacgtcgtttttcgattgccttattagcttgtttgattggctaatcaacaattattgttaatcagtgcctaaagattgtttctaagtatcaaatatggttaaatgatggacgaaggtgatgtcatattatctaacatgagttgtgattgaaaatcgttagattcagagaaaagccactaacctaggttcggttgaaagggtcgggttgggggagacttgttggctcagtgcgtgttatatcgacttatcggcatttgtgctgatcgtggtgacgtttcagtatgttacctagtctcggaaggtcggaataggctgaacgtatgtagacggccatcgaaaactgataattttaactcacgatacgtaatatgatgcaattaaatgaaaaggacctgaaagtatggatacaacggtaatgattgaagaacacccacagattaaggaattgatagcaaaacgaccaattgtttggcagaacccagattatgggaagcgggcggacctgccgttaacgcgggccgatatttttgacgcggtcgcacgttgggaacgtttcgcaccatttttggccgttgcttttccagaaacggcagctatgaatgggattattgagtcaccattgttaccacttgagcagatgaaaccagcatgggaggctctcaaccaccagtcattggcggggcagctttatttaaaagctgatagtcagttgccgatttcgggttcgatcaagtcacgtggtgggatttacgaagtgctcaagtttgctgaacaggtagccatggcccatacggatttaacgtatatggatgattacagtgtcttggcaacggctaagtatcacgagttatttgcacaatacggcgtcatcgttgcatcgacgggaaacttggcactcagtgtgggcatcatggccgcaacgtttggatttaagacgaccgtttatatgtctcacgatgctcgtcagtggaagaaggacaaactgcgggcaaatggcgtcaccgttgaggaactaaataccgacttttcaagtgtgattccggtggcccgtgccgccgcggccaaggatgaccatacgcactttgttgatgatgaaggttcacgtgacttattcctcgggtacgctgttgctggggtacggttacaacatcaattaaaagtacaaggtatcaagatggatgctgcacacccggttgtcgtttatttaccggccggggtcggtggcagtcctagtggcgttgcttttggcctcaagatgattatgggagctaatatttatcccgtcttttgtgaaccgacccacgtgccgtccgtgaccttagggatgatgaccaagctgaatgaaaaaattgctgttcaagacattggtttagatggcctgactgccgctgatgggttagccgttagccggccatcacgattggcgggcaaggtgatgcgaacgctattactcggaacagcaacatttgaagatgatgatttataccgttatttgacgaagctcgtcgataccgaagatgtaatggtcgaaccatccgctgcagccggctttaccgcgatcgcccccatcatggcccaatttcccacgcttgctggcaaagacgtcacccacattgtctgggcaactggcggcgacatgatgccggaatcggagcgtcagttggattatgagctaggacaaaaattgctgaccaagattaacaatcgttaaaacattgctaacgcttatatcagtgctgatatttaattaaaatgcgacatcccaacaacggggtggcgcatttttgtttgcagtgcggtgacaaatgggctggaaataaagtaagtgagtgacaactcattttgctgttgacaaaccgagatgtactgattatactaaagccattaagtgagtgagtatacactcacttagagaaagagggttattaaaatggcaacggattatgtcatcgccaagcaggtcagcaagcactttggtcatcagcaagtgctcaatcagattgatttgacactgccggctggaatgatttatggcttgattgggccatcaggagctgggaagaccaccttgatcaagagtattttagggatggaggctgtggacagtggcactgttaaagtcatggatacggtgatgcccaatagggcggtaatggcacaagtagggtatatggcccaaagtgacgctttgtatgagacactaacggcccgtgaaaacctgaccttttttgggcaattgatgagcgttccaaaaataaagttagcgcagatgattgattatgcagccggattagttgatttaacgtcccaattagacaagcgggtcagtggctattcgggtgggatgaaacggcgcttgtcgttggcaatcgccctgattcaggatccccaattattgattttagatgaaccgaccgttgggattgatccagaattacggcaacaaatttggaccgaactaaataagctcaaggatactggtaagtcgatgctcgtgacaacgcatgtcatggacgaagcagaacggtgtgattatctcatgttgattcggcacgggattgcgcttgctgaggggacacccgcggcactgaaacaacagtatgcagtagatacgatcgaacaggtctttttgaaagcggggcggatgcaagatgcgaacgatggcaatcgttagacgagtttttaagcaaatgttacgtgataagcgtaccttggcgctgatgtttttggcaccactcttaattatggcgttgatgtattttttgtttcaaaataacacgactcaagtggcgactttaggtgttcacaatgttgatcatcaggtggtcaaagccattaatacgaagcatgtcgatattcaccattacagtagtaaccaggcaaaagcgatgattaagcagcatgatttggatggatatttgacgcaaaaagatggcaacttaacgatcacgtattctaatagtaatccgaccaatacgtcattgatcaaagcttctttgcaaagcggactggtcaaattaaaaattcaaacgttggtcacggctactaaagcacaaaaaaaggtgttgcaaacgcaacaggtggcactacaaaagttgaccgcggcgcaaaaacaggcaacggttagcaagctaaagactgccttggcccaagcacaggcaagtgggaatactgctgctgcggctaaaattcaaaagcaattgaggcaggctacagcgagtgctgcggcgccaacaaatagtcaatcacaaacgacgacctataccactagcagtcattatatttatggtagtagtgattcaacgttctttgaaaactttttgccaatctttctcggtttctttgtcttcttctttgtgttcttgatttctggcgtttcacttttgaatgagcgcactactggaaccctaagccggctacttgcaactccaattcgacggagtgaaattattatgggctatctaattggttatgggggctttgccatcattcagactgtcctgaccgttgtttttgcaattacggtcttcaagattcacttagttggtagtatttggctggtctttctgactaacttattattagcgttagtggctttgaccttgggtatctttatttccacctttgctaactcagaatttcaaatgattcagtttattccactgattgttgtaccacaaatcttttttgctgggttgattccagtcgatggcatggcgagttggttgcaagcaattgcccacatcatgccgttatactatggtgctaatgcgttgacggctgttgtgacaaagggtgctgggcttggcgatattggtgtcaatttgttaatattagtagggtttatggtcgtactaacaatgttgaatattgttggaatgaaacgttatcggaaggtgtgaggatatggaacgaccacggatacgggattattttcaacatgatctaagtcagaatgaaacgattacacctaagcaacgggccatcctccaggcaagtctcgatttgtttgctgaaaagggttttgaccagactagtactagtgatattgcacaacgggccggcgttgcggaggggacggtctatcggcggtataagactaaggctgccttacgggatgccatcttagcaccaattgccgcacacattgtgccaattttagcgagtgatttttcagaggatgaattacggcagcgttatcccagtctacaggcattcgtcacagcaatttttacggaccgagttgcatttgctaaagctaacgtgaaagagttaaaggtcatttttgaaatggcagcttttgacgccgaacgacgcgaacagattcttagccagatcgcgcctaagatggtcaagcagatgggaagtgtcataaatcaactaaaagcagatcatttgattgtggattggccgaatgatttgatactgcaaagtttgttatcgcagctattcggttacctagcgcggttaatgctggaattgccgggaactgaaattgagcgcgaacaagcgtatttgattacggtgatgaccaaaatattgaccccgggtgaacatgatcaaattactggtcagtgagctaactgttacttgttataaactaaagccacttctgtacttagcggtcatttgaacgctaagtacagaagtggctttggtcgttgctacgcgtgttcgtttgttaatctgctagtatcgtcattttattcaacaaactagtttgtaactggctgagtgtggttgtcatgtagaccgggtaaagatctgggttgacgagccgctgggttgttcgtgggagctcggcaagtttagcctgggtcgttgcctgaatggttgtaaccggaattgacgtggtgttggacaaatctaccggcgcgagtaagggccgggcttcaaaatgggtgagtcgctgttggcggtcgacactgagtgggtcactgttgacgacggttaggctggtcgcatcgacgatcgtctcggtagctagtgcaatcaagtcagcaaaggcccgctgagttcctggttcgtacagacgatagacttgcttatcaccaggaatcgttagtttttcgcgactggcactgaccttgatcttgggggtgctctgaccattgctctcagttgccgcaagcttgtagacgccacttagaaccggtgcggacgcgctagtgatgagcttttcaccgataccaaaattatcgatcggtgcgccttcgtgcaacagcgaagtaatgatgtgttcatccaatgcgttagaaatagtgattttggcattgggaaagccagccgcgtccaattgtgtccgggcagcttgtgataaagtcgtgacgtcccccgaatcgattcgaataccgacgggttcatgcccagctgctcgtagctccttaaagaccgtcaccgcgttaggaatcccagagttaagcacatcataagtatcgactagtagcgcactattgtcaggatattgttcggcccacttgcgaaacgccgttagttcatccgggaaggcctcaatccaactgtgggccatggtaccagcaacgggaatatcaaacagcttcgcagcgagaacgtttgaagtactattggcgccaccaataatggctgcccgggtgccgtaaagcgcgctgtccgggccttgcgcacggcgcgcaccgaattccataattggacgtcctgccgcagcataactcagtcgacgagctttagtggcaatcagtgattggtgattgacgatatttaaggcgagtgtttcaagtaattgcgcttgctcaagtggcccagtgattgtcaatagtggttcacgaggaaagaccggggttccttctggtagtgccttaatttggcaagttaacttaaaatttgccagcatggctaagaaggattcatcccataggttaagttgacggaagtagtcgaggtcactgttggtaaaatgaaaatcttgtaaagcttcgacaacttgctggaggccggccgcaatgacaaagctaccattgtcaggaacccggcgataaaaaaggtcgaaggtggcgttggtctgaggtaagtcgtgatgaaatccatttgccattgagagttcgtataagtcggttaataaagataaattgcgcattgctaatcaatcccgttattaagatttaggtgtcttgacacctatgataaatgaacttagtttatcataatttagtatttgatgaaagctattctactggttttctggtagaatgattctattgaaagagtaagaagggtgagtcatgacaggatcagaacggcgtgaacaaattcgatcaaaattatcgcaaacgcagatccccgtaagtgcaacaacgctagcgaagcagtttaacgttagtcgtcagaccattgttggggatatttcattattgagggctcacggaacggccattgttgctactcttcaagggtatgaattagaaaaagcggatcagccaactgctgtcctagtttgccgtcattttccaaacgaagcgatgcaggaaatggccttgatcattcacgcagggggcataatcaaggatgttgaagtcgaacacccattgtatggccggctccggggtgaattagagattcgctcagttggtgatgttaatctgtttatgggccggctcaagaaattgcaaggccatttattatcagaattaacagatggcgtccatagccatacggttgcttatcagaccccagaacaattaacagccatcaaggcagctttacgggatgcgggttatttgtatgaaaattaatgtcaagacatggttaatattacattggtaatcaattgatattcgttagttttatttacgcacgatgctggtgattaaccaggataatgtcagtaaaaagatgtttggagatctagtcggatcttcaaacatcttttttgaatagaataactatttgccgttgcaaaagcgctagttgttcataacgattggtcgtgatgttgatcgtaacattggctggtataattcctaggtattatgtcggtcgttaatcaataatttgtttattggcggttttatgagggctcgaagtgatagaagcacggtggtgagcccgttgaaagtcgaaagcaacgttttccatcgcaatcgggattgttaattgcctgatgatacgtgactcatggctgttcactatgaatggcctgatttaatggccgcaacagcagtaacgtatacccaagtagtagaattccgttgatgattagtacgagaccgccatgagtggtactttgaaagattaaagtgaacataagtgttccgattggcatgattgagctattgactgttgttaatgttgcaacgactcggcctagtaatttagttggcacggtttgctgcaagtagacctgaaaagttatattaagaataacaagcgcgaaagccaatattcccatgataaagctaccaagcagggcatatccagttggtgattgggacgtcatgaacagaacacctaatagcaatatttggctatcaagaataagtaccggaataattaattttaaaaagagacgtttctgaccggttggcggtagcaaagttaaaagtagactgccaagtagcataccaattgcgctcccggtttcaagcacgccaataggaccattacctgtgtgaagctgatcttttaagatgtacggaattccaatcgtaacagcagtatataagaagttcagaataacactcaacagaattgtaattttaatcattgttcgcgaccgcatgtaatttagaccagaatgaaattttgcaaactgactgtgcgaagttactggggcgtgttgtgaattagcgaattgattagttgcgtgataatgaaatttcattgtgagcataatgccaaatgaggcgagtgtggcaacaatctctaatataacgaagccagaaaagccgactaaactgtataacccaacgcctaacgctggtgatagaatcgaggaaagagaaattgcactttgggttaatgaacttagacgttgaatgttgtgagcgttaacaagctcatgggtggcggcagaataacaggtatcattaatatttgtcgaaattgcatcgataattagaaaaagaacgattggaatgagttttgctgttgccgtaaataagttgatactagcagcgaataaaattagtgcaagcgtgcgggcagtcaggctaccagtgagaatggttttgtgcggataagtatcaatcagattgccaattgggacaaggcaaagcaagccaacaattggactgataatcatgttgataccaaagctaatggcagagtgtgtttcatcgagtaacatgagtccaaggccaaaagtgaacattttaccgcttagtgaactaatgaaattacttgcggcagctttgaagatttgcaagctagattgatgattactaatgttgatggttaaatcaggttgtttgatggccatggcgagttcctttcggtagtatgaattgattagaaatgaaaaatggctaatctaatataattttaatgtttttaattgaattgtcaattttcgctagacagcacctagtcatgatgaaacaggtagccggtaagtatttgtatagttggtgaagattctgaatatatctggaagattaagcatgattgctcaaatgaaaaagacagatctttttggaaaaatagtggttgctgtcatatttaagcagtcgcccattcgaatttaatcacatcggattcgaattatggttgatagtttgtaagtcgatattcaaatccagtgccattcaacagtgtgcttttaaactagttgctggtttaatttgatgggcgacaaggataatcatgaaggctcgtcggttcaaggtaaatgacagttgttttttagagattgcagtgtgttcagcaaattcggtttaggtcacgtggtaatagggcataatttgtttaatgtattagtgggaaatgtcgttggcgttgcagtgatagcgacagcatgatcatgattaacgtgatttattcgaataatgacctcactttctaatagcaattgaagcctactgcgttggaatattcctgtcgagtaaataaccaacgtatttgctaaggtagcttaaacatggagactaatgaggtccgtgatttgagggcaattcattattattaagttgatttgctcacggctccagcttaatcgactggtgctagtatctgttgccatctgattcgtaaatgacttaatctatgcaaatctcaataccagtcagcgtctgaacaaaaagtgggccgccagaatgattattctggcggcccactttgagtcagtcatgctgcttatctaaattaagcacttagaagtagtcaataagtgctggtcgttctttaactagactagtgtcaagtcggttgatcgcattcacatcaccggtgattaatccgtgttggtacgcccgggctaagctctgggtgccaaagcaagcagtggttaattgctgaatcgttaactgaatgtcagccggtccagttaattggtcgctaacccgattgagcgttacttgcccgttgtgccgcgtcaatgaccagattccttgattagcagggagggtagcgtcactgactgctaggcgaattggttggatgtccgtgagaaacggatagcgcttgataaagtcatataaatcaacaatgcgggccatcatgtacggctggacagtcacttttaaacggtatgggtcggctagtaggtccaagccgttggtcgcacttgggctatcataactaaacgtttcaaaggtggtgccatgcttagtgataaagttagccaatcgttcgaaagcggtcggcgtgctagtcacccattcttgaatcgcaaagttagtggcctgccgttcatagatcaaatagccctcgatattggcagccgcattgcggtaaattgcgaccgaccaatgatgtttgagagtcaggtaatgttgccaccaggctggtcgaatcagaccaccacgctgattttgcggttgtcgtgcataaaaatcgttgatttgggccagtccgtcattgccatagcgggtgatcgtaccagaccagtccgtcggtttgacacgtggtaggtctggagcggccatgacttggtgcgcgtggtcgaagacgtgttcatagccaaaacgacgatagtaaccgtacgcgaagggggcaaggtaggacagcgtcacgtggttggctgccatttctgtcagcgccgtcgttaacagctgtcccgcgccaccctgaccggcatattcaggcgcactcatcacgtcgccaataccattcatccggtaggtgacgccatgaaagttgactgctagtggcagactgtatagcccactgaccagttgaccatgatcgtgacggccgtagatccagccatgttggtagcgatccatgaaaaatcgccgccgcgcgggggtatcgtgattattgaacgcgtattgataaagttggtagaaagcttcgcggtcagcatcgctagttaaacggtaatcagttgtcattaatgcgacccctccattcgttgagtactatttggcagcgacaaatttaaagtcggcccacggttgtaacaagttaaggcaaggtaagtcactcttggtaatatgaccaaccacattgattcggccagtattttcaagattttggcgtgcaatctgcaattcacctttgtattgcccaaactcatcgttatcgatcaagacatcaccggtatgaatggcatctaggtgatgagcaggaaaggcttcgtctttgtagatgacccgggtctgagaagaacgaatgacgtaatctgaaaaatcaccgcgataagtctgtggttgcgcaaagagtactttttcttcaactgccgatagatcagcaacggttttgacgtgtagcagtgggtaagggctaaagaacacttcagcagccgcttttagttcggcttcactcgcgtaggcgttaccaattaaaacgtcgtcgatcagccccgtcattttcaaatgttgaacttgtgccgcaatcggtaacccccgatgatcttcaagggtacataacccgtcttgcatgggccaaggcccataagtcgcatcatttgatgaaacaaacgcggcggtgttgatgccatactgacggtattgttcagaagtctgaacaaaataatcataaccaagaccagtgtattgttgtgggtagaagttatgtgagcctagtaagttatctttttcaggtgaataatccataatcgtgtcaacatagtgagtccctttggacatgttgacttcaatcttaatgccgaattcgttgtgcgtcatccgggcttcttcttgaccagtgaatcctaggtcgaggcggacaccccaggcaccgaggtcgtggaagaatgacaagtcgtcataggacacgccaagttgtttgaagaggtcaggattgacgtcgaccattacttgcaagcctaattggttcgcgtaagtgatcacttttttaaagttggcaaccactgcggcttggtcccctttgatttcaagcagtgaagtgaatacccgttgatagccatattttgcggctaaatcgaggtacgccgcatccttttcaaaggttgatcgttcgggataaacggaaacaccgagtttactcatttaaaattcctccaaataataattagtttctgtattcgcttacattatcgcacaaataattggtccgtaccagtaaaatagacaatttgttggtaccaatttttgcctgtcactccacgcgggattatgatacgatttgggtattaataattggaggtatcatgatgacatttgaagctattttacctgaattaaaagctggtaagcgcgctgttcggactggttgggaagggaccgaattgttcgtcgaattacagacggcaaccactttcaacggcgacccgctgaacccgtactttttaatcaaaacggccgatgaagcctatagtatgtggtcaccaacagattgtgatattttagcgacggactggcagttggttgactaatgcaatttgatgaatatcgtggacagactgtcttggttactggagctgcctccgggattggcttagcccaggtccagagtttcctagcccagggggctgacgtgattgccattgatcggcaaccacagccatcagcgctagtaacgacgtcagccctgcgctatgaaattgctgatgtgaccgacactaatgcgctcgtcgcggcgattaaatcaggagttaacgtactcggcaagccaaccgtcgtgtgcaatacggccggtaagttagacggttatcaaccaactttagcaacggatctgaaaacgtggcaagatattttggcgacggatctgacaagccagtttatcgtgactaatgcggtgctacctgcaatgttagccgcacaacacggcgttttcgtgaatatggcatcgatcgctggactggtgggtggcggaggcggcgcagcgtataccgcagccaaacacgccatcattggttatacgaaacaacttgacttggactatgcggctcagggaattcgcgccaactgcattgcgccgggggctatcgataccccgatgaatgccgctgattttgctggcgatggtaagatggcgaaatgggttgccagtgagacgcccgcaaaacggtgggcccaaccgcaggaagttgcagatctgacgctattcttagcgagtcagcacgctgattatattcatgggacggtggttccaattgatggtggttggttagcaaaataggaaggggactttggtatggcttgtattttttgtcagccgttgccgtatattttggagaatgacctagcagcggccttcttcgataaaaagccggtgagtccggggcatttgttgattattccgaaagcacattatgccacgtattttgatgtgcccacggcgaccaggaatgcgatgctcgccttactgacccaagcaaaagcgtacctagatgcgcacaatcatccggatggctataatattggcattaacgttgatccggctgcgggccaaaccgtaatgcattgtcatctccatctgataccgcgatatcaaggtgacgtgccagaccccgcgggtggcattcgtaagatgctgccggatggtgtaccggatttgagatagattaaggagtagtgaatgtgtatggcagatttatttgagaaagttggccggcctggtaaggtcctatcaacgacaccggtgtatcatgggccgatttttgatttggtcaaacaaacgattcaaacacctgatggattagaagtaaaacgcgatttgattcagcatgggaacgccgtcacgattttagccatcactgcggatgatcaagtcgtgctaggttcagagtaccgggtcggtcgcaatgccgagacgattagtttacctgctggcctcattaatgcgggggaagatccgttaacggccgcggcccgtgaattacaagaggagacgggctacattgcccatgaaccacaaattatgacgcaaattagctcgtcggaaggtttcacggacgaaacggtcagcttgattttgactcacattgatccgcaagaacatggcgaacgacattttgacgcggacgaatacgtgaatacgcaacttgtcccgctcagtaaagtgattgacctattaaagaatggccagattcgttcagcacaaggaatctgcgcaataacatggtacttgaattttattcgatagaagtggggtgcggaatgaatttagatgagaagtttgcgtatatggcgactggtcagccgtatcgagatacggatgcagaactaacggcgttgcgtgaccaagcgacgttgacaacgaacgcggtcaatgcgactgctgatccagagactaaagaaactttattgcgacaattggttggttcagctggtcgcaagccatttgtaaatcctaattttcgcgttgaatttggacggaacattcatctaggtgataacttttatgccaactatgattgtgtaatgttagatggggcgccaattacgatcggcagtcaggtcttgttggggccaaaagtcggcctttacacgagcaaccacttgtttgatgcaaccgaacgaattaggggcggctgcatcgcccgaccaatcacaattggtgatggttgttggctagccgctaacgtcaccgtattaccaggagtgaccattggtgctaacacgattattggtggtgggagcgtggtaacccacgatattccagctaacgtgattgcggctggcaacccttgccaagttattcgaccaatcacggcggccgaccgcactggttacaccggggcgcaattcgaattgtcatgatgaacgacaaaataccaccttcgcaggttgttacctgacggaggtggtatttttgtgttcagcgcgtgaaaagtattctgacagatacgtgcagtgttattagaagatttaccagccagcagcttaatcgtccttggcattgtgagttggtcactcatacggtgactgttccaccggtatcagggtttaactttgatgccgtttaaagcagcagccaaataagcagcctgatcaatattgacgatcataccgcgtgctgtggcagtatcaagttcgagacgctcgaattgacaggtacttaggtcaatatttttgagggcggtatcgttgaaagcgacttggtcaaggttggtttcgttaaacttgacggtcgttagtcgattgttcataaagctggccccattcagccgacagtgatcaaaggtcacggttttgaaccgcatgtcgcacagcatggctaagtcgagctgacagtggtcaaaggcgacgttattgagggcagcctcgttcaagtcgacaccgacgagcttacaatctttgaattgaacgcgtagccagctggctttttcaaactggcaattagaaaagtcacaattgataaagacggcatcggtcaagtcaagccgttcaaattgactggccgtaaaccggacattttcgaagtgcacgtgatccagcatggggtgatcgatgtgctggtgactcacgtcttcttcactaacctgaatataacttaagctgtggtcctcatctgctaaaatatcgaaaaaagcgccagtcgttaattctgctgggataatgcggggatcttgcatgggacacctcgttagtttgattttgagttgttgtgctaaaaaagaagcccgttacaggcttcagtttgggatcagttgaagtaattttctaggaaaacggcgaccccgtcctcgtcattactcagggtggcattggtggttgcagccttgaccgcaggaatcgcattcgccatcgctacgccaactttggcggcggttagcattcctaggtcgttttcttcgtccccaaaggccatcaagttgtcatagtcttcattaaagtgaccgaggagttgtttcaaaccactggccttatcagtatgcggtggtaagaattccaacaaagtccgccgggatgggaccacgtggaagaaatcggtaatttgacttggtaatttggcctggactgttttagcatcttgaccagcactaacgactttaccgaatagatcatcagcaggcaggtcggcaaaacgaacattcttaaatggcattaagccttgcaagaattcttcgtacggtgacttgcccagatccgtaatggagtagacttgcttcaaatcaatcacgtctaagtagaaatgatcgcgctgggcttgctcaaataagggttgtaaatcttgtttggtcacactagtacgagcaaggacgtcaccagtcgtgttttgctgaacgagcccaccattaaaggtaatcgcgtagtcagttggttggttgagttcaagttgttgtaagtatggttgaatcgccttaattggtcgcccagtacacagtacgatccgtttgccggccgaatgcagctgtttgagaactgcttcagttcgcggcgaaatcgtcttctcagaagttagtaacgtattatctaggtctaacgcaatggtcgtaatcatcttggtcacactttctagttaagatttaaaattgttttaatggtcgttcccatatcatcaacatccgcaacccgcttatggcgcacgggcgcagtacggagggctgtgaccgttgctggaatgggcgtttgaatcaactcatgtaactgatcaactgcggctaggccatctaccgcactaagctcaccagtaattgccgttaggacggcctgtgggaatttatacggactagcggttgaaacaaccaccatgggccgctgatctctggttgcggcttgatactgtttggcaaccgccgaggccacggccgtatgtggatcgattgtgtagtgatgggcatggttcaggtgatgaatttcagcttgatcttggctttcagtcacgaagccggcccaaaaatcagctaagttggcacgcattgccggtgtaatcgtataacggccggtcgtttgcaaatcagtcattagtttagcagtcgccgtggcgtctgatcctgtcaagtagaagaggagccgttccaagttacttgagactaagatgtccatggacggtgaactcgtcaagaagaattcacggtttttatcataagtcccggtattaaagaaatcggtgagaacgttattgcgattggaagcacagatcagtttatgaatgggcgtgcccagttgtttggcatagtagccagctaaaatatccccaaagttcccagttggaacactaaagttaatctcatcaccgttcttgatttgcccctgcttgataagttgagcgtaggtgtagacataataggccacttgtgggaataaacgaccaatattgatggaattagcgcttgagaattggaactggtgggtggctaattccgcgtgtaattggtggtcgtttaacagttttttaaccgttgtttgggcctcatcgaagttaccgttgatcgcaacaacactagtattggctccggtttgggtcaccatctgctgtttttggattgcgctgacaccatcttttggatagaagacgatgatgcgagtctgatcaacattggcaaacccggccatggcagctttaccagtatcgcccgaggtggccgctaaaataacgacttcggcttgtaaatggttctttttaactgccgttgtcatcaaatgcggtaggatttgaagggccaagtctttgaatgcaatggtcggtccatgaaaaagttcaaggtaatactgctgaccatgcttggtgaccggcgcaatttgggggtcatcaaactgatcaccataagccgcgtcaatgcaggcgtgtaattcatcagcggtataatccgtgaagaagagtttaaggacctcgtaagcaacttcttggtagctcatcgtggcgagctggtcgaagtcaaaattagcggtcggtagcgttacgggcacaaagagaccaccatccggcgtcaggccttgaagtacggcttgtgatgacgtcatggtgtgacttgcagtttcgcgggtactgcgataaagtgttttcatggataacgtcctttcaactgattttgactaaatgatacactaaaatcgaggcgaacggggacgttttcaccaaaatcatgaggataattgacgtaaatggtctagttaataatgtaatcgtttacataaaaggagatcttacaatgcaactagctggaattaggcaccgccctgaaagtgaagatacagccgtcttagccgcacatcaactacaggtacgactacaaactgcgcgtgacgatgttgcccaagtggagattttgtttgccgattcttacttatggcaagaaggaacaacagcgctagagcggcggataatgcagcccggattagcgacgcagggcaaccagtactggcagacgacgctgaccgtaccgactaaccgggtggtctatgcctttctgatcacggatacgatcggtgcgacggttggctatggtgagggtggcttctttgacgacgttgccactaactggcaaacagtgggcaactattttcacatgccatatatgcacgtcagtgatgcggagctgccaccggcatgggttaaggagacggtctggtaccagatctttcctgaacggtttgcaaatggtgtgcggcaaaatgacccggctaatgttcaaccgtggggtgctgggcgtgttcaccgtgattcattttatggtggggatttgcccggaattacagcgcatttagatgatttggctgcactgggggtcaatggcctgtacttgtgtcccattttcacgtcaccatctaatcataagtatgatacgatcgatcattttgaaatcgatccccactttggtacgaaagccgattttcaggcgctagtcgatggcgcccatgcgcgcggtatgcgcgtgatgttagacgccgtctttaatcattttggcgagcagtcaccacagtggcaagatgtgattaaaaatggcgagcagtcacggtttgctgattggtttcatattcatggctggccggtgggacgtgatccgaagacgaagcggcttaattatgaaacctttgcgacgggagcagcgatgccgaaagttaacacccagaaccccgcggtacaagcttacttgattgatgtaaccaaatattggatcgaacaattcgggattgacgcttggcgttttgatgttgctgatgaggtcgaccatggtttctggcgagcgttatgtggtgccttgcgggcaatcaaacctgatgtgtacctattaggtgagtcttggcatagtagtcaatcgttagtcggtaacggccagtttaacgcggttatgaattatccactgacacaaccaattctggcgttgtttaatggtcaactcaaccctgaagattacgttggtaaaaccaatctggaattaatgatgtatcgtcaacctaatcaacaggcgatgttcaacgcgttggatacgcatgatacgccacggctactgaccacgttgcatggtcagttaactaaatttaaatctgcactcacgctactgatgctattgccggggagcccgtgtatttattatggaacggaagtggccatggccggtggtgccgaccctgacaatcgtcggtgcatgaactggcaaccagacgagcaagaacaacaagttcgacaatttgtcacgcgtttgatcaagtttcgccggcaacaggccgactttttagcaactagccaattgacatggacgattgatggtcactgcttaatcttaacgcggacggatgttgaacagacgattcaaggccgctttaatttgggtgcacaggcagtctcaacagtaagtggcgtatcgccaatcttaacagcgggtattaccgcaaatgagatggcaccgggaggctttgaattaaccgtggcttagttgtgaagtagtgtcacaagtcgactggtggagcgttctgtgtgtttcccagttgaaagcttcaagaccgatagccgccattaggacagtcgcttataaaaaaacgattctcaatgtctttgagaatcgttttttttattaatcatgatgaagcatgcagcatgacaaatcaaatgttatcaccgtaacaaacactgaagagcaagattgttgccgcatttgacaataaaaaacgcctagcaacttgcttggcgtttaaaataatcattatttagctgtctcaggcttgatgccccggccttggatgaattcgatgacaatcaagacaacgtagcagattaggacgatgcctaagaggttggttgtcttaacggtgctggataaccagtagtactgccagtcttgattgttgaagacccaccatactaagaggccggccaaggcacctaatgtattcataattgcaataaagaaaatgttgccgttttgtttttggctggcccaatatgcggaaaggatggccatccaaacaccccaaacaatcaagccaacaacgacgacccaataaattagtgacgcgatcatgtgtactccttctttctacaagttaataactttattttaccatgaattcgattacattggcaccgtttcagtgattattttcacaatctgcttctgaatgattgtgttgaatttgctggattacttgttatttaaggttggattatttacaattagaacataataatgtaattgagaaagggttggcaatcaatgacttctgcatggaattggattgggatcattgcgtggatcattgttttggcgttagtcgtgtgggtatttcatcatattcgcgtacgacgcatcaagatgatcgtggaacgtaagcatacgtttgagtggggaaatcttatcattaccaccgttgaattaatcgttagtctcggattactagttggcatgggatacgtgactttcaatcaccaggtcgacctgtcagatgctaaggacgttaaggtaacgtatcaagttgaaccactggttttgcgagttgggactaatggttcctactatgtcgcggtggatcggggcacgacccaaaaacccgtgcatatttataattactgggttaatggtgcgaaatatactgtttcaagtaacaaggcgaccgtggtgactaatctttcgcaagttaaagtggcggatgctggtattccgtggtcacaaaagcagctggttaaagaagaccggcagcacgaaaaagcctacgcagtgaagctgacagccacttatcagccgtcattctggaatggcttaggtgtccatgtggggcatcaagccatgacgcggtggttaattcgtgtgccagcccagtcatttattaatacgaccgatgtgcaatctaactaaataacaaaaaaagtaatcgaaccttgtgcgttttagtagccaagattcgttttttttcatagaattattaaaagttgttaaatattcatattcgcatgctttttttaggaaccttatcataattctaaggtaaaatgtaactgttatatttttataggctaattaatttatctatttaatcgtatgactgagagaaggaaaagattgatgattaacgaaccagcaattagtccactatttgtttgtggtatcattggtgattcgacggccatggtccttaataaatccttaaccgggccgttcaagaaccgttatgatttagtaaccgcaccagtgacgacacgggccacgttgagtgaggccgttagtcagattgcacaacttcaaacaggactacaaactgttatttcaaagcaacttgggaccgtccagcttacgattccagccttaacaacattagaattgccagcaacgttaattaatatttattatttactggaaccggtggggggccatttgttgctcaaacgaccgcattacaccgaatcaatgtcggcgggggccgctcgagtgccacttgatcaattaaattggtcgaatagttcgccgcgggtcatgcaggccaagcgtttcttacagaccggggcgtttcctaccgctgaccaacgaatcgatggctaccaggttttagagcaagcgcaattttaaagacgttgttgactttttaatcttcacgttgtaacttagaagcaacgtgaagattaaatgttgatgagaagagtaacaataagttgatgcctagcgagtcaaagtagtggtgtaatttgaccatcagcttattgtgaagatgaactcggagttggctaatggttgatgctattagcccggattgaccaccgataattgggttgaacgtaacgagtacgttgcgtgagcgacagcaagactgtaataataggtggtaccgcggagtataaacttcgtccttagtaagttaaggacgaagtttttttgttgagaaagaaggcctttaagatggaacaagcagcatttattaagaagtacgcaacaacgcgccagcatacggattcattgaagtgggacgcactacaagctcggtatggcaatcctgatttgttggcaatgtgggtcgctgacatggaattcaaagtgccagaacaagttacgcaagcactacaagaacgagtggcgcatggcatttatggttattccattacgcctgatcgttattatcaagcctttatcgattgggaacaggcacgccatggtctgacattgaaacgcgattggattcgatttggtagtggcgtggtcaattcgttgtacgcgctcgttaatattttaacgcaaccaggtgatggcgttttgattctgacgcccgtgtactatccatttttcaacgcggtgcgggataatcatcgtcagctggtcacatctgagttacgcaatgatcgtggtcactatacgattgactttgaagatgtggaacagcaaattaaggcgaacgaggtgcggttgttcattcaatgttcgccacataatcctgtggggcggatctggtctgaagatgaagagacacggctgttagcattatgtgaacagtatcatgtgcttgttatttcagatgaaattcaccaggatttagaaattgatcggaccaaccatccgttcaaatcggcgttaacggtagccaatgggcggtttagtaaccgggtgattgtcgtcaatgcaccgtctaagacgtttaatctggcggcgcttttgaactcacatctagtaattcctaatccaaaattacgacaacgctatgatgcacaaatcgggcgcttcagccagactgagatcagcgtcttaggccaggttgccggccaaacggcttatgaatcgggcgcggcctggttagaccagattttggcaatcgtccgtgataattatcattatttatgcaccacctttgccgcccacgcgcctaagttggttttagccgatttgcaggggacgtatttgacgtggctagatttacgcgcgtacgttcagccagctgcaacgaaagcgtttattcaagatcaatgtcagctcgcagttgactttggtgagtggtttagtcctgatgatcaggggtttgttcgcttgaacttagcgactaatccgcaaaatgtgcgtgaggcggctcagcggatcgtcacttgtttatcacaaatgcaaaaataaccaaaaaattccgacaccggcgtgttggaatttttttaacgacttttattggtaaccgtgcgtcgcttgagcaaacgtcgtcgagtaatctctcggcgaatgaaggagtaagcaatcaagctcagtgccagtataccaatgatgacggcggttttaacgtaaccgaatatccagaaaaaaactgcaatagcgaacgtacagtaaacaattaagaacatggaagccctccttcagtcaagtggttgtatgagttgataaaaccattgtaccgagaaaaagtagctaactcgtgattgaaatttgaattttctgttaaggattgcgaaatagttttgaatctcctggtaaatatgctgatgttgtaaaagttaatcgcggtatcggcgattcagccggcgttcattagcgtgtgcaagttggtcggtagttagctgataggtggtggcaacttgaagtttcttcaaaccagtttgaatggcccctagctgagtttggtcacgggcttgtccctggagtttagcagtgatttgcgtgagcatgttcagttcgggttggagcgtttcgtgtacttgttggttatattggtgttgactcagactgtgcgtctgccagcgcgtgacgcggcttagtagggccattaactggttggttagtaggttcataagatagtcagtttcttgatttgtaaatgtcatcaaaacgggacctccgatcaataaagttggttaactcaaatattagcatgagtaaggataatttaattactattttaataaaaaatggtaaaaacgactgattatgagttttaaacacaactatgcttgtgaagcgtgatacattatcaataactaagtgaagggagtgaatcgtcatgattgggcatattacggtaatgcaaccagattacgaccaaggcatcctgactgattttcatggccggcattttaaatttcggctaaccgcagtttggccgtcaagtgcgttgcatattggcgcggagttttattttagaccgcagctaaccgcggccggtttagttgcggtagagttacggtatcagcaccatgatgggacttgtttgtcagttcgaccgccgaatgaggtcagtcaacaagtcatgatacgaattggagagttagctttaaatacggatgacattcaatactatgcattgacgacggatcaggccgaagttcgcaatggttatgcttcatcagcacgtcatttggtgattaagatgcgctgtggtcgccaatatattttttataattgggatggggtcaatattgatgatgtggtcacaaagttagcgacgttacatacggtgcaacgccagtttgggtgaaaaatatggttgctaaaatagtagctaagttaagtatcagaaaaaaagatgggtcggtaattattatgaataaaataagcgtcgcaggaattttcggacattcctacgacgcttgttttgatgtttaagttggttcgctttaatgaccacggtccttgaaaataaatagtttactgaagaaccaattgagtaataccacaataatttgatcaattaatttgacgataaggtcgtttccgtgcagaaccgaaataccgacaatcataatcccctggtcaataaagtaactgagtaggcggaatccgaagaatgatgtcatttcaattaaaacagcacggaaagtaggtgtttgtgagtcaaatacccaaattttattcgtgatataggcgaatagcactgagatgagccaggcaatcgtattggctatccagtagggccagaattggttgaaaattccaaaaacaataatattaattagggtggttaagcccccaaagattaaataggaaaggacgctttgatagcgttgccagagttgtttgataagttgtcccacagatgaataccctcactttagctgattattactaggtaccatcctatcataattaaatggctgcgtgttggatatttttagtgcgattcaagttggtggcgctgatgattaaaggcttgctgggccgtggcaaagttatggtaatgtgcgtgggacacggtcaagcggcccagtgtagtggttgcacggatgtctagccgatagacatcgggtccgagacgcaatttgcttaaccggatttgatatgaaagggcatcgttgattacaattgtatggctggcgattaggcctggtcgaatacctaaagaaagcatactattcacccccaagtggattaactccaattgtaaggggtaactgtaaatatcagatgtcgttgttgtaaatattatgtaaacccgacactgctagccggcgagctgctgtgcataactggtagttagtttatataaatgataacgcaaccaacgctgataaatggtaaaatagaattaacagatggaaagggcgtgacgtcaatggtacaagaatattcgaatattttagttcccctcgatggctcacaacaagctgagattgcgcttgataaagcagttgcagtcgctaaacgtaatgaggcacatatcgacgtgttagcagtcattgatcccggtcagtttgggtataatttagctggtttggcggatggtgatattacgtatcaattggttcaggattctgaagcttatttaaaagaaacggttgatcaagtcaaaaaggatggctttacggacattgccttccacattcgaatgggaagtccgaaaccaattatttcacaggacttcgtcaaggatcatcataatgacttgatcatgatgggggcaaccgggttaaatgccgttgaacgcgtgctggaaggctcggttacaacgtatgtgcagcgtaatgcgttgactgatgtaatcgtggttaagacggatttgcaaaatacgcaggttgaaaagtagcgttagtgggaaaaccacttctcgaatggtgtgacgtttgtattaaccattaaaaaatgaagcaggtcgtgaagttaataacttcacgacctgcttcattttttagattatcagcttaatttctgattcttaacttacggttgaacagataagcgagaccaccgatgataccgcaacctaccagcattgtgatgaatggcatggttgggttaaagtaaccagttgtcgcttcaccgtggctgggataaccaataataaatttcaagaagttttcaagtcccgtgtaattataattcgattgattgcgagtcataatgatgaccattatccaaataataagcatgccaatgatgggggtgccaatgattaaaatcgttttggcccatttaccaaataacgcgagtaaggtcccacaagcgatgccggtaaggccaacaccaatgtagaaaatccagttaaagcataagctagctaaaatgtttagccagacctgacttcccagcgcatggctatacagcgaatagcccgttctcatcaacgcggtgttggtgctccagtgtaaatacggagcatgaataccgtagtaataaatggcattgatgatgacaagcaaaccactaagcatgagtaatgcgaatactcgagcttgaaagtaggtttgtcgggaaatcccattttggattaagagcttaaagttgtcgtaagtgagtgaccccacaataaagataagcatgaagaagagtggcccgaggcttaggctagcaaaattaccaagtggagaatactgccgaatattacccgtaataactgcaaatagtagcggtagtattccgaatacgacgaataaagcgagtaccgaccaccccgtcattttcaattgttccgttaataaataacgggtggtgttgcgaaccttaattgacatgagcggcggcctcctccttggtattagtcaggttaacaaatagtttttgtaggtccagatgctcgaccgtgaccgtatcaggaattggtcggtcgttatctaatggcccgtaaacgtagtgggccgtaattccgccaagatgatccttgccgataatatttaaaccatccgtataagtgctgacatcagtttgtggaccagttaccgcgtaagattgccctaggatgtcggtgacatcaccatcaacaataatatgatgatggtccagcacaaagacatgttcaatcaagttcgtaatttcttcaatgagatgagtcgaaatcacgaatgtgcggggatggtcactataggtttcaatcagttcttgatagaaaatttcgcggtgattagcatccagaccgaggactggttcatctaaaaagatgtattcagccggtacacataacgcaataatcagtttaaaaattgttcggtaacccgtcgataatttgccaaatcgcgcgtttaaatcgaggccaaaggtttgtgctagttttttagcataagtgtcattaaaatcaccatagagtagtgcggtggttttaaacagttgtttgacccgggaacgctcagaatagaggttaacttcactcatcaagtaaacctttcctaacgtgcggtcgttatcacacatggattcgttgtccatggtgaccgttccgctgtcagcaaagatacgattgctgataatgttcagcaaggtacttttaccagcaccattgcggcctagcaaaccgtaaatcgtgtttggtttgatcgttaggttaagattatccaggacggtttgaccgcgaaaggcctgctggacagcctgaacttgaatactcatgattcggaaaacccccgttcaattaatttagctaattcatcttgcgtaatgtggagcttttgtgcttcagcgactagttttttaacgtagtcggtgtagaactgatcccggcgcttttcaacgattcgttgttgtgcaccggcgatgacaaacatcccgaccccacgccgtttttcaatcagttgggcatcaactagaatattcatgcccttaagcacggtcgcaggattaatatgaaattctttagaaatctcggttgtcgaaggaatttgttcaccttcagcgaaggtttccgtaaagatagcttcttcaatttggtcggcaacctgcaagtagattggttccgtgctattaaagttgaactgcattttattcacctcattgcagtgattgccctatttcgttgtggccttttgttgcggctggtgcagttgtcgttcggtacgatcgatccgggcagcaatccaactagagagtaggaggagggtgcccagtacggccagtagaatgtcttgatgttcaaagataatctgggtggctaaaccgaagttaacgctcagccacagaagcggcatgagcgcccctaaccagaattgacgacgacttgcgagcacgtaacggtgtaatggtgtaataacgattaataaagcgactaatccaaagtataccatgatttttccctcctccgaaaggttattgtaaaacgattcgccgatagatggtgatcgtaatgagatagtaaagtaggtagagaccggcaaaaatcaagaatggtaaccaaattccggtatatggtgaggtaaccattatgattttgaacatttgtaacccaaacaagacgtgtacaataccaacgattccaggaagaataaagagcacagcaatttctttgttaatggcaccgttgagctggcgtctagtggttccaactttatcgagcatcttgtaacggtgttgatcagcatcggcaccagacagaatcttgaacatcaggcaactagctagcattgcaagaaaggcgattccgaggaacatacccataaattccagcccggagtacatgccgttaaccattagatacatcgcatagcgtcctccaaattgttcagggctggtagtgtgaaagtgatgtttggccagtttgttcaatgcaacgcgatgttcgataacgttgttggtagtaaacacagttagtcgctgttcaggctgggcaagtttcgcgtacgccgtttttgataaaaatacgggtgttgcggttgccatgacaccactctgaagctgcatcagttgataattatcttctgatttttgtaatttagccgcattattatgaacggtattaaaagtcagttgattcttattgcgagtatgaatagtcgtgaatggttgccgattgaattcagcagcttggaaataaacgactttcttggttgctttgaaatgataggtcgccgttgtcttgggcttcatcgctgcaatttgtgctttttcagcggtactagcgttgaccagtcccatatcataagcgttattaatattagccattgatggaatttgactgtgaaagcccattccaactgtaattgcgccgagagctagtgcgaatagcattgcgacaattgacagcatcttagtgtaattacgaattctaaagcttagctgtgataaggtgaagccattcaaaccacgttgggcaaatgagaatcgtttgagtgcgaccattaaccagacaaaaatagcgttaaacagcagataagttccaagaacaattgtgacgagcgcaattccaattcccatcagttgcaaaattttcaggttagccattgaccagtaaccaattgcaattgaaatgacaccgacgacaatttcgatgagttgacgggctggttttagttgtggccggttaggttgatcattactgtgtagtaatttcaaggctggtgtcttggtcagggatagcaggttgaataaaccggcaattaagaacaatccaacgtagagtaacagtgtcgcaatggcagctggcgtgtaccaggctgtaaaatggtgaagcgtcaggcctagactgttaatcagaatctggcttacgccgacagttaaggctgttcccacaagaatgccgacaatggttgcagtgataccgacaagtagtgtttccagccaaattaattgaccaatcttacttttgcgtgcaccaacgagcatgaagagcccgtagtctcgcttacgcatacttaataagaatgagttagcatagccaatgtagactaatgtgatgattgtgagtagtacggaaccaaattggaagatgaggccgaccatactaatactcgtattttgttttaagaaatcttggttagtggccagtgcttcaaacatatagaagattgcgctagacatgatcagtcctgaaaagagaacgaggtagtcgcgccaacggtgtttgaagccggtcatggcaagtttagttaacatagtttaaaggactccttttactgtttcggcttactgttcaaacgtccctaggttgtcgaggacttgttgataaaaatcactgcggcttaaatccccacgtttaagttcttgcccaatccggccatctttgatgaataagattcgttgacagaagctagctgaaaatgggtcatgggtcaccagcaagatagagacagcccgttcttggttgattttggtgaacaggtcgagtaattcacgcgctgacttagaatcaagggcaccagttggttcatcaccaaatagaatagcggggtcattgattaaggctcgtgcggctgccacacgttgcttttgaccaccagataattcattaggatagtttgataggaattcttcaattcccaattggtgtgcgactttttcgacagctggcttgatctttttgactggcgtattttgcagcgacaatggtagggcgatattctcgtaagcagtcatagtttctaataagttgaaatcttggaagataaacccaatctctttggcccggaaatcagcaagttgattgcctttcagatgtgtaatcggttgttgatgaatcgttacttcaccgctagttggttggtccagtgtggccagcatattgagcaaggtggttttccctgaaccagatgcgcccatgattccgacaaattcccctggttgcacattgaaattaatgccttttaacgcttcgtattgtttgctgcccgccttaccatacgttttgtgcaggtcgctgacggtcatgattggtgtggttgtcattttaaatacctctcttaagttagttggtttgttatttggttaattacttatgtaactaactataaaggcaactaacgcgagtgtcaatcattattttctcgcttgatagtcattgggacgtcaaacgctgatttatcaacgtctagcgagtggccaatcggttagccccgagactgaaattgagtaataaggtgcactgaggttagtgacttcgtcctgaaggggtaactaaccgacgaaccgattaacgaactagttgataagtgaactaaccgagtgactagcactatgtaggctaataaaacgtactgatctggttgctaggttttgtaaattgtttgaatggttgctagtttttttagttgatatcacttgtatgagaatctaaggaagttgtcatgaagaaccagtgagggtggattgcaattaggcgatggcaagcctaaaataattttactgttagatgtgcgtaggcacgtgaaaagatgaggaggagtattcttgaagaagattttggtattacacactggtggcaccattgcgatgtcggccgatgaatccggcaatgtgacccccggagatgaaaatcctttagacaattatcagagttcatttggcacggatattgagttagagactgaggacgtctttaacgtgccgtcgccgcacatcaccccggcacggatgttgcagttaaagcaacggatcgataaggccgcacacgaaggggtcgatggggtggttgtgactcacggtacggatacgctagaagaaacggcgtattttctagatcttactttaccgaatgagctccccgttgtgattaccggcgcaatgcggtccgccaatgagattgggtcggatggtctgcataatctcgaaacggcgattcaaacggctagtacaccggatgcggccgaaaaaggtgttttagtggttatgaatgatgaaatccactcggcccgctacgtcactaagacgcatacgaccaacgtggccacttttagaacaccgacttttggcccgattgggttagtcgctaataaaggcattgtcttttttgaatcattactacggtcaacggtttgcccgattcaaacggtcacggataatgtttttctgatcaaagcatatgccgggatgggaccagaactatttgacgccattgcacaacccacgactcatggcgtagtcattgaagcattgggagcggggaatttgccaccggcgacgttaccagctgtgcaaaaattattagacatgcagattccggttgtactggtttcccggtgcttcaacggtatcgctcaggatgtctatgcttatgaaggtggcggtgttcaattgaaacaaatgggtgtgattttttgtcagggattgaatggacaaaaagcccggattaagttactggtgggtgtcagtgccggtatgtcgaccgatgagctagctcgatttgtagcgactgccaattcataatcgacgtggcgcccctttgagccctgcgcaacccgtgtatgggctactcgtgacacaaaattgttggatagtttgatcgccagtagtcatagcggacgatcaatcataaaaaaactgagccatcacttcatcattatgaagggtggctcagttttttatcagctaaagctaaagatactattgattgatcagattttgacgaattagccgggcaacatatgcttcgtgaagcaggtcaccgtgactaattgatttttggttaacagtcatggcggtatagcgggtaacattgttcataaataagttgccaccagcgttcacactgctgagcggtacgatatcgtcgttaccctcgccagtgtcaccggcaatgttgatgaccgcatgcaatttcttgaattggttcttgtgatcaagaagtggtgtatagagcgttttatcaggatgtgcagcatcagtacccaagaatggggtgccaatcaacatcaaatcgtggactgctaatggtttggacgagctcaaacctgctagatagcgactccagatcaggccaccatttgaataaccgagtgcgttggccgtggtgagatgttggtgacgttgcaaataacgaatagctttggctaagccgttcgtttgggtcataatgttctctgttgagtccgtgctatcttcgaaaaagatcacgatgagggcatcgttaaggttggtgttctcgacgcgtttttctttaaacgccaatttttggttcgccttaacagtcagggtgatgagcggatggtgctgttgctcattaagtgaacggacgatgtcatcaaagtcagtccgcgtgctgctactacctccaatcatgatcaatggccgtttttgcgcagtaatcacgtgactgactttatcttgatggatttgtgttgtcagtccgagaccgacgatcaataaaagaaataggccacttgcaatcaagccccagattactttcttaggcatcagctcaccccattaaaattatttagaaacgttcggcaatgattggccgatcgtttaacggttgaatcttgcggttattagcggcaaataattgctgataagcagctaattgttgttcaccaatcatgacagtatcggcacagacataccattcaacggtttcacttagtggcggcgtcgtcaatgagcccaagtagtgatagacagtcccggtatctgggaggagctcagttaagttgaccggtgttgtcagttcatggctcgtttgggctgtgaactggtcaagtaagccttgtaaactagaattaggcttgccaatccgtccaaaaacggcgacgacggcgagctggccggtagcactttgatgaacgagatgccattcgattggtgcggcttgcccatcgattaagtgttctgccggcgtatgaaagtgaatctgttgaaaggcaaagtcgcggtcgttcaaataagcggcaccaattccactagccttcaaagttgtcgcttcgcccgtaatcgttttggcttggtacaagcctcgccagctgatggcggatagctgtgaagactgaacgtgttgtgtttgaatatcgattggtgactgatgttgaccactagtcatgggccaatcagtttggtgtgcataatcaaatgtcatcgaaagatcctccgttatattattcagtgaatattttttatttagtgccagtatggaaatttatggctaatcggtccaaggttgtgatgctgtttgtcagcaaacgtgttctggattcgacgggccgtcgctggctatgtaacttacattatagcacgcgttgatgtcggttggtgtcgatggtgctaacgaattatcttggaaataaagcgactgattcggtgattggggcaccgttaaactgaccgataatgttagaatagaaaatgaaaagttaacagataggtggtttcaaaaatgacaaatcaacgtgtattaactgtaccaggtggcattaatttccgtgaactcggtggttactcgactaaagacggtcgaaaaatcaagtggcataaggtcattcggactggtggacttgatcaattaacgccagccggccaagctttgctggatgattatggcgtccgctacgatattgactttcgttcaccacaagaagtcttagatgcgccagatcgaattcctgccaatgctaagtacgtgtacgcaccagtgttcaatgtggacgaaacgcggaattctgacggtactgacaagatgacggctaacttggagaagcatccagatagtggattcaagcacatgctaaaggtctatcagatggtggccgacgagcaacatgccaaggacgagtatcgccggttctttgataatctacttgcaaatgatcaacccgattcgacgttactatttcactgcactgcgggaaaagatcggaccggaatgggggcggtatacctgttaaccgcactcggagtcgattttgaaacgatcaagcaggattatctcttaactaatcaggcttcgattggccggatcaatggtgcgatggccgaagcacgtgctcagggcgcatcagatgcaacggtcgaaagtattcgggccctctggtcagttgatgcggcttatttggacgccgctatgaccgaaattaaacgacaatcgggtaatttaaaccactatttacacactgagcttaaattaactaacaatgaaatcaatgatttgcaacggatttatttagaataggaagtgtgacgatgcgctatcttgcaagctccagccatgatattcgcacgaatcttgccattgagacttacttgatggaacatgccgatttgacggaaccgattctatacttttacattaacgccccctgcatcattgttggccgttaccaaaatgtcaaggcagagattaaccaggactatgttgacgcacaccacattacattgacgcggcgaacttctggtggtggagcggtttatgatgaccttggaaatgtcagttttagttttattactaaggacgacggggacggttttggtaactttaagcggttcacagcaccagttctaaaggctttacacgcgatgggggccactggtgcgacgatgagtggccgcaatgatttattgattgatggcaagaagttctcaggaaatgccatgcacgttgagaatggccggatgttctcccatggaacgctgatgtatgatgtcgaccagacgcaaattgcgaaagctcttacggtgccgaccgataagttggcctctaagggtatcaagtcggtccgaagtcgagtcacgaacttgaaaccgtacatggcgccggcttatcagcacttgacgattgaggaatttcgcgatacgttggcccgtgaaatcctgggcgtggctgatttgagtcaagctaagacgtatcagttagatgaaacggcactggcaggggtagcagcactgaaccaacaatattttaccaactgggattggatttacggtcagtcaccagcgtttacagttaagcagcgccggcattttgatgctgggaccgtcgagtttcagttaaacgtggtggcagggcgcatcgaagcagttacgatttatggcgatttcttcggtgcagaaccgattgctcccgtcgttgcacggttgactggtgtgaaatatgaacggcaggcgattatgacggcgctagcaccgttggacttaacccattactttggtcgaatttccccggcggatttgattgatttgatcgtagcgtcgtagctttgtgaaaaaatttgttaagcagatataattgcggcaacgttgcgcggatactgaatttacttgattgcacggataagcctaatatcagtgagttcagttgtttgcatagtaaaactgaaagcgcttaaaattgttttgctttctttagtgaaatccactacaatatagttattgactaagaaattatataatatttgactatttgatcatagaaggagttgttctcaatgcacaaatttatcgcgatggttggaactaattcagatgagtcgaccaaccgtaagttgttgcaatatatgcagtcccactatgcggatcaagcagagattgaattaatggaaatcaagggtctaccaatcttcaataagcccgaaaatcatgaaattccggcacaggcgcaagcaatggcggataagatcgaacaagctgatggtgtgattattagtacaccagagtatgatcattcggctcccgcggcattactgaatgctctcgaatggttatcattccatatccagcccttcgtggacaaacccgtcatgattattggggcctcatacggggcactcggcacatcacgggctcaagcacatctgcggcaagttttggattcaccagaattacgggcgcggatcatgccaagttcagaatttatgcttggtcattcattgcaagcctttgatgaccaggggaatttaacggaccaacagaaagcgacgaagctcgatgggttgttcaaggatttccaagtctttgtcgaaatcacgaaaaaattaaagaatgccaacgcgacgacgtatgaagaagttcgtgaaatggattgggaaaaattatagagagggcgacgacgatgaaattagttggaattgcgggttcaattgaagataagtcttataatcggttactgttaaagtttattgctaatcattttagtgacatggttgatattgaaattttggatattcaagatgtaccaatgtttaatcagagtgatgatcaaacagaaggtgaagctgttcaatatttgaaacgaaagatcatgcaggcggacggggtcattattgcgacacctgaacataatcatacaattactgctgcacttaaaagcgtgatcgaatggttgtcgtttaaaattcacccgatgtcagggaaacccgtattgatcgttggcgcttcttactatgatcaaggttcgtcgcgggcacagttgaatctacgccagattttagagtcaccgggtgttgatgctgtggtcatgcctggtaatgaatttttgctcggcgaagttaagcaggctttcgatgaccaaaacaatctgaaggatgctcggactgtctcgttcttacaagaaacgttaggcaagtttctgaagtttgtcaagatggtcaacgcgatggatgcggaagcacacgctgatgattggaagaatgaagaccttgaggctaagggcgaagttgaaacgacaatcaagggcgtcaacatgcatgcggctgattgggtcgaacaagcggctgccaagacccatgcggctgagggtgacgactacgttaagctcgatcggggtgtgctgaccgtcaaccaattaaattggttcctcaactcgatgccaatggaattgacgtatgccgatgccaacaaccaatttttatactataaccatcaaatggatggcgacaagatgttagcttcacggacacctgctcaagccggtaatccactagctgactgtcatccaaagcgggccgtacctggtgttaagcgagcggtacacatgctacgaaccggtgagactgatctcttcaagttaccggtacctggtatccctaataagtatgtgatgcactattatcaagctttgcatgacgataagggtgagtacaaaggtatcaacgagtttgtgctcgacctcttaccaatcgtgaagtattacctgaagcagacgggccagatgttagcacctgatccagatgctaagacggacgccgtttcaggagcttcatcgaaggcgaaggaaacgaagcctgatgctgccccagcggtggatgatgtctctggcgcttcagccgatacggaagccgcaccagaagcaccaaccaagcctgaagcacttgatgtcgatagtgtttccggcgcttcagcaaaataattagtaccttaaaaagtcgggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgccggttcttgataaagcttttaatattggtcattagctgaggactgacattttcgacatgacctagtgctgctttgaaggatcgataatcacgcttttgaaaagccttaactaaggcatgtgcggcttggtaggtttgtcgaaactgttggtctagatttaaactggctacgactaattgctctggtgtcatgcgatctttaagatgcgcaaaccattgaggtttgcgcttttcgaggctgccataatcttttaaatataaccgccaataatatttaagcactcggtattcacgactcttagggttaaagcgtttcatgagttggacccgagtttgattcaaagatcgtaaggccatttgaacaagatgaaagttatctgcgactagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaaaattgtaatgatgtcgtgggtttgggcatccaccgcaataaaactcatttgtttaccagttgaacgaaattcgtcgatacaaagcatcgttggtagtccgttgaaagctggttgggtaccttgtccgagtaactttattcggcgactaatcgtattggtcgagacattgtattgagccgcaatactagccatcgtacggtcttcagttaatgatagatcaatggcatgcagactgttttcagatatttgatgatgttttttaaccagcgtagtcgttgttaaactacttttaccacaatttttacagataaatcgctgcttctttaagttaaggatggtgactcgttcgctaattctaggaattctgatgtgaacggtcttaaagccattcttaaccatggaacgtttgccacaacgtgcgcaaacagtaaccggatacgttagctttgcaagcacttgtaagcttccgttagtagcttcttgaacaactaaatcagtaatatttgggtctttaatttggagcagtactttagtagaatggtcttgggacatatctgacactcgctttcaattggttttggtcgacttgattgtagcacaggacgatatgtccttttgttgtacataaaaatagtgttgatggattttatccatcaacactaaatatcatagacccaaaaagtctcgaggaatcacttccttgagactttttttgcgttattttggtcacttcaatccgatcctttaggaaagcgttcgcaaattaagttgttgattgtttttaagttcagtggcagtcagtttagccccgctataaataatctgagttagcataaacatgcttagttgctcgtcctacgccgattcccagtcattgctgttaattgttggtgcgcaccgacaaaagttaatggcccgtttcaacggatagttgttgataatggtagcagtaagtttgttatggtgaaatttagatgatgacggattgttcggaaatttcaatattaataatattatcaaaatagtcgcttgaaatcagttgataactttttccagacaccggaaacctgcaaacagtgaggtaattcgtacatgttgaggtagcattaatctaattatcaatttcattaacacgaacattaaaacgttaattaatagataaagttaagaaattcgttgacagcgtcccgcctgattgctaaactaatggtgaaaacagggaaagagggatcatgatggcgaaagttggtttgattatggggtcaatttctgattggccaaccatgcaattagcggcagaacagttaacggcactgggagtctcttatgagcgtcacgttatttcggcccaccgaatgccccagacattacaatcctatggtgaagaagcagcgtcacggggaattcaagttattattgcgggtgcggggggcgctgcccatttacccgggatgctagctgccaatacactactcccggtaattggggtgcccattaagacccatacgttgaacggagttgattcgttattgtcaatcgtacagatgccagctggcgtacccgtggcgacgatggcgattggtgatgcgggggctaagaatggtgcgctaatggccgcccaaattatcggtttacgggaaccacaagtacaacatgcaattggagaatttcgtgctcgtcaacgtcaggaggctgaacaaagtgaacgccaattttaaggaagcactcttaccacccgcaacgatcggaatcgttggtggcggtcaactcggtcagatgatgacgcttagcgcgaaggcgatgggctatcgggtaggtgtccttgacccgacacccaaagcaccggcagcccaggtcgcagattttcagattgttgcggcttatgatgatcaggcggctttacttgatctagcgcgccgtagtgatgtcttgacctacgagtttgaaaacgttgatgagaatgctttgattgctgcgcaagcctatgcaaagttaccgcagggcactgcactcctgcatattactggagatcgtcttaatgagaagcaatttcttcatgatcatggcatcccagtcacatctttcgcaccggtggcggatttacagtcattaaattacgccctcaaccgtgttggtacgccggcaattctcaaaacggcggcaggtggctacgatggtcacggacaaacggatctagacacagcagtggtgacaaaagccgctagtgccttattgacacagccgtgcattctagaggcgcggcagaaatttcgaacagaagtttccatgatggtgacgcgtagtgctgctggtgttgttacgacttttccgttagttgaaaatcagcatcaacatcatatcttacacacaacgattgccccagctaatgttcagcccagtgttcatagtgcggcccgcaaaattgcggtttcgattgctgaatccctgaaactacgcggcgtgctaggaatcgaattctttgttttaccggatgatactttattagtcaatgaactggcaccacgcccacataattctggtcactatacgattgaggcctgcaacatctcgcagtttgaggcccatattcgaagtatctgtggcttaccgattccggccattacgcagaccagtccggcagtgatgcgtaatctgctaggtgatgacttaacagtggcacgtcaacagttggttgaacacccagaatggcattttcacgactacggtaaggcggccattaagccccagcgcaagatgggtcatgtcaccgtattaaatcacgatattgacgcagcattagcgtcggtggcaaatttgaaaggggaacaataataatgacggcagcgattgagaaacaagctttgctttacacgggtaaagcgaaagcgatgtatgccactaatgatcctgaaattctatgggtcgaatacttagatcaagcaacagcgctaaatggtaagcggaaggttcccattgaccagaaaggccgattgaataatcgcatcgcgagtttgattttcaaagacttagccaatcacggcattgccaaccattttattgagcaaccttcagactatgtgcaacttgtccgtcgcgtgaccatgattcccttggagacagttgttcggaatgcggcttcgggtagttttgagcgtaaatttgccgtgccacacttaaccaaatttgcagaaccagtactggaatttttctataagagtgatcagctggatgatccatttatcaatgattcacaaatccacgcgctaaatgttgcaacaccggcaatcgtggcggaaattaaacggcaggccttacaggttaaccagcgtttgatggcaatttttgcggcgatgggggtacagctcgttgattttaaaatcgaatttgggttgacgaccaccggtaaagtcttgctggctgatgaaatctcaccagatagttgtcggttagtcgacctaaagaccggtgcatcgcttgataaggatgtcttccgcaaggatctaggcgacttgactagtgtttatcaggaagtattgacgcggctagcaaccgttgaggaggcctaacatgtacttagttaaaatctatgtgacttataagcaatcaattctagaccccaagggtgaggcgattcatgatgccttacaccgacttggatatacgaatgtcgatgccgttgaattaggtaagtattttgaggtgaaaattcacgcggatgatcggccagttgccgctgaaatcgacgagatgtgtgatcgcttgttagccaacgttaatatggaaacttatcgttacgaaattactgagatggaggctttgtaatgatgaaatttgccgtaccagtctttcctggttctaattgtgatcatgacatggtgaatgccttgcgcgatattttacacgttacggctgatttgattccggcgacagcgacctcattagcaggttatgacgcggtggtgttacctggtggcttttcgtacggtgattatttacggagtggtgcgattgcccgctttgcgcccatcatgccggccgttattgcatttgctaacgctggtaaaccagtcatcggaatctgcaatggctttcaagtcttgaccgaagccggattattacctggtgcattgcaggccaatcgctcagcgaagtttatttgtcaggacagcccattacgaattgccaatcatgagacgatttttaccaccgcatacggatcgacagatcaaattagtttaccgattgcccacggcgaaggcaattattattgtgatgagggcaccttggcgcaattacgtgctaatcatcaaatcatcttcgaatacgtcgagaatccaaatggcagcacggctaatattgctggcattacaaatgaagcgggaaatgtgcttgggatgatgccccatccggaacgggccgtggagatgatcttaggttccacggacggtctcggaatttttcaatcggtcattgcgagtcaagaggaggtcacccatgcttaaaaagcaaccattatcacctacagatgttcgcgattctaaggtctatcgggattggggcttaaccgatgctgagtatcaattattaacggataaggtccttcaacgcttacctaacgagactgaaaccgggttgttttccggcatgtggagcgaacattgctcctacaagaattcaaaaccagtcttgaaaaaattttggacgcagggtgaacaggtacttgaagggcctggtgaaggcgccggtattatcgacatcggtgatggtcaggccgtggtctttaaagctgaaagtcataatcatccgtctgcagttgaaccttatgagggtgcggcaacgggtgtgggtggtatcattcgggacatcttttcgatgggggcccggccgattgcgctgctggacagtcttcgctttggggaaccgactgatgctcatacgaaatacttgatttcgcaagtagtcgccggcattggcggttatggcaactgtattggaattccgacaatcggtggtgatacggtatttgatgcgagttatcagaagaacccgttggtgaacgccatgtgtgttggaatcttggatcaagctgatattcagaagggccaagcaacaggaattggcaacgccgttatttatgtcggcgcaaaaacggggcgtgacggcattaacggtgcgtccttcgcctctgctgaatttaatgacgccaatgaaacccagcgttccgcggttcaagttggtgatccctttatggaaaaattattgatggaggcgtgtctcgaggttattcatgatcatcgtgatgttttaatcgggattcaagatatgggcgcggcgggcctagtttcctcctcagccgaaatggcgtccaaagcaggcagtgggttgtcactgaatcttgacttggtaccacaacgtgaaactggcatgacgccgtttgaactgatgctctctgaatcacaggagcggatgttactatgtgtcaaagctggtgccgaagcagaaatttatcaagtctttgaaaagtacggtcttgatgctgtcacaattggtaaagtgacagccggccaccagtatcaattattccatcatggtaagttagttgcagatgttcccgtcgatgcacttgcgaccaaagcgccggtctatgaacgcgaaaagaaacgaccaacgcgcttgaaccatcagagccatcatcaatttatgccacgactagttgatgcaactggcacattgaagaagatgctccaacagccaacgattgcttccaaagcgtcgttatatggaacgtatgactcgcaggtccaaacgaatacggtcgtcaagccgggttccgatgcgggggtcatacggattcgacatacggataaggcgttggcggtcaccaccgatgttaacgggcgatacttatacttaaacccccgtgtcggtggagaaatcgccgttgcggaagctgctcgaaacattgtcgcttccggtgggcaacctttaggcatcactgattgcttgaactatggtaatccagagaaacctgaacaattttacgatttggacgaatcggcgatgggcatcgctcgtgcctgccaattattcaatacgcccgtgatttctggcaatgtctcgttgaacaatgaatcgaacggggaagccatctatcccaccccaatgattgggatggtcgggttaattaagcatcagaaagatattacgactagcgattttaaacacgctggcgatgcagtctacgtgttaggtaccacagaagccgatttcaatggtagtgagctgcaaaagatgttgacgggaacaatcagtggcgagctgtttgattttgaccttgtgactgaaaatcgtaatcagcgtctattgttaactgcgattcaaaaaggactagttgctagtgcccacgacgtttctgaaggtggcttgattacgacgattgccgaatcatgttttccacaaaatatcggggtggaactggccagtgacttgcccgctgccaacttctttgcggaaacgcagtcacgatttgttatctcggtgacaccagcacagcaagccgcgtttgaaagtttaatggaaccatatgtgacctatttaggacgaacaactgcaacggatcggctacacgttcaaactgctgatcaggcgtttgatattaaggttagtttcgccaaacagttgtgggaaggggccttaccatgcctactgaagtaagaagtctgaatgaagaatgtggcgtctttggggtttggggctcgccggacgccgcccaattaacgtactttgggctccatgcgttacaacaccgggggcaagaaggagccggtatcacggcgaatgatcacggcaaactgcagacggaacgcggactagggttgttggctgatgtctttcgggacccacggcggttggcacgtttgacgggtcaagctgcagtcggccatgtacgttatgccacggctggtaatcatggattggaaaacattcaacccttgagttttaattttagcgactcacagtttgcactcgcacataacggcaatttgacgaacgcggtgacactgcggcgacggttggaacagcatggtgccatttttcatgctagttctgatagtgagattttaatgcatctgattcgacgcagccccgcagcaacgttaacggaacaggttaaggatgctttacgtcaagtccacggaggctttgcttacttactactaacgaatgattgtttgattgccgctttggatcctaacgggttacgaccattagtcgtcggtcagttacccacgggcgggtacgtcgtttgtagtgaaacttgcgcgcttgatacgattggtgcgacgtttgttcaagatgttcagccgggagaattgttaacgatcgatgatcatggtttgacgatcgaccattatacgactgatacacagttggcgatttgttcaatggagtttatctactttgcacgtccagattctgatattcacggcgtcaacgtccattctgcacgtaaacgaatgggtgctcagctcgctgttgaacagcccgtggacgccgacattgttgtcggggtacccaattcatctttatcagcggcgaccggctatgcggaagcgagtggcctgccttacgagatgggattaattaaaaatcaatattcgtcacggacctttattcagccgacccaagcattgcgagaacagggggttcggatgaagctttcagcggtcaaaggtgttgtcgctggtaaacgagtcgtcttaatcgatgattcgattgtacgtggtaccaccagtcggcggatcgtcaaattattgaaagatgcgggtgcaaagtcagttcatttacgaattgcatcgccaccattacgctatccatgtttttacggtatcgatattcaatcgactaatgaattgattgcggctcagcaaacgattcgggagatgtgtcagacgtttggtgcggactcacttggttttctcagtgaacagggcgtcgttgatgcagttggcttgtcgaccaccgaaccgtatggtggactatgcatggcctattttaatggggattatccaacggccctgtatgattaccaagccgagtatgatgcggaaattgcgcaattacaagccaatcatgaaggggtgatcaagtgagtgatgcgtataagcgggctggcgttgatatcaacgctggttacgacgtcttaaagacggtcaaacaaatgagtggcaatcagcaattaggcgcgtttgggggggcgtttccacttagttcggatgcaactgccaacgatcccgtgttagtagcggggacggatggtgtggggactaagctcttagtcgcaatcgctgctgatcaacataccacgattggaattgacttggtcgcaatgtgtgtgaatgatattttggcacaaggcgcgaccccccagttctttttagattacttaggtcttggacatacggatcagaagcgggtcaaagccattttgactggcgtcgtcacgggctgtcagcaggcccatacagcgttgattggtggcgagactgcggagatgcccgatatgtatggtcaggaccattacgacctcgctggttttgcggtcggaattgcgaaccgcgcggacctgttatcaccagcaaatgttcgggctggggacgtcttgattgggttgccgtctaatggcctccactcgaatgggtttagtctagttcgtgatattttattcaaacaacacgactaccaattgaccacggtttttgacgaacttggtcatgatttacaaacggaacttttacgaccaacgaccatttacgttgatgcagttcaaccattattacagcagaaattagtgacgagtatcgcccacattactgggggcggcttgattgagaacgtcgccagagcgttaccggcgggcttgagtgcgcaccttgaattgggtcaatggccggtgccgccaattatgacgttattggccgaactcggtgggctgactgccacggatcttcggtcgacctttaacttaggcctgggaatggttttggtcgttcaccccgaccaagtggcggctgtgacggctaatttgacggccaacgcgcagtcctattatcgcgtcggaacagtccaaactgggacggcccccgtcgttttcgaggaggctgaacatgcctaataagattgcggtatttgcttcggggaacggcaccaactttgttgcactccaccaagcgattattgaacggcagttaccggtggtgattgggttactcgtctgtgatcaacccacggcgccggtcattgataaagcccgggcagctaacataccgatattgattgttgattttcatgattatgcgaataaagcggccgcggaagccatcattttgacggccttgcaagcgcgacaaattaaactggtcttattggccgggtacatgcgtattatcggtccgaccctcttgaatgcgtattcgcataaaattatcaacatccacccagcattgttaccgaaatttccaggtcgtcacggtatcgaggatgcttttgacgctggtgtgactgagacgggcgttaccattcactatatcgatgccggaatcgataccgggcaaattattgcccagcgggtcgttccggttgcaccagacgatacgctagccagcctggcgacccggattcatgattgtgaacaccaattttatccagatgtattacagacactcattaatgaaggagcaatttaagatgacaaaacgtgcgttgttaagtgtttctgataaacagggattaactgattttgcgaagggcctcgttgcccttgactatgaattgatttcaacgggtgggaccaaaaaggcactggaagcagctgatattccagtcatcggaatcgaagaagtgaccggttttcctgaaatgcttgacggtcgggtcaaaacgctccatcctaaggttcacgccggactattagcacgacgtgacctgccagcgcacatggcgcaattaaaagaagctggtattcaaccgattgacatggtcgtggttaacctgtacccattcaaagcaaccattcaacaaccagacgtcacacaagctgaagctattgaacaaatcgatattggtggtccgtcgatgctgcgttccgcagctaagaactttgccgcggtactgccaattgttgatcctgctgattatgagcagattctggctgatttgcagacggacgcggtcacaccggcactccgtcaacggttagcggccaaagtttttcaacatactgcggcctatgatgccttgattgcccaatatttaacgactgaagaatttccagaaaagttgacccttacttatgataagaagcaggccctgcgttatggtgagaacagccatcaaaaggctgccttttacgaaaatgccttaccagcgcacttctcgattacgggtgccaagcaaattcatgggaaagagctttcttacaataacatcaaggatgcggatgccgccttgcggatggtctgtgaatatcagcagccggccgtagttgcaatgaagcacatgaatccgtgtggggttggcttgggtacgacgattgaggctgcttgggataaagcctatgaagccgattcgatttcaatctttgggggaatcattgccttaaatcgcccagtcgatctcgcaacggctgagaagatgcacgcactcttcttggaaattattattgccccgagttttgatgacgatgcctttgctattttggccaagaagaagaatctgcgcttgatgacggttgactttgagcaaacgcacacggccgataagtttgaaacgatttcagtcggtgggggcttactacgtcaggaggtcgacgcggccttcgaaacgccagctgattttaccgtagtcaccgcaacccaaccgacacctgcgcagctaaaagcacttgctttcggccaacaagttgtgaagcacgttaagagcaatgcggtcgttgtaaccaccgcagatcggacattgggaatcggttctggtcagatgaatcgaatcgattcaactaagattgccatcggtaaggcgatgcaacaagctggctacgaaaatgctatcctagcttcggatgcgttcttcccaatggatgattgcgtcgaatatgctgcgcagcacggcattcgtgcaatcgtgcaaccaggtggtagtattcgtgataaggattcgattgccatggccgaccgttatggtattgcgatggtcaccactggtgttcgacacttccggcattaatgaaaggatgggtgcgtgcatggcaaacgtattagtagttggtggtggcggtcgcgaacatgccattgccaaggcaatgatggcaagtccgcaagtcagtaccgtctattgtgcacccggtaatccaggcatgatccgggatggtattcggacactagcgattgacgaaatggactttgcggggttggtcaactttgcacgggccaatacggttaccctgaccttcgtcgggcccgaagtaccgctagccgcgggcattgttgattactttcaagcagccggcctggctatctttggccccaaccaagctgcggcacagttggaaagttctaaggtattcgcgaaggccttcatgagtcgccatcacattccgacggccgactaccggcaatttcatgaattggattcggcactagcttatagtcatgaacaagcggtgccgcaagttatcaaagtcgatgggctggcagctggtaaaggggtgacggttgcgacgagttatgaacaagccgcggcagcgattaagacggcctttaaaactagttcgacggtcttgatcgaggactacgttgctggctttgagttttcccaaatggttttggttggtggtgagcactatgcgttattaccgaccgcccaagatcataaacggttacaggaccatgaccggggaccgaacacgggtggtatgggggcctattcaccagtaccgcaaatcacgcccgcggttatcgatcaaacgattgcgacaattattgaaccgacgattgcaggtctcaaagccgatgggttaagctttgaaggggttatctatgttgggggaatcctgactgcgaccggtgttcaagttattgaatataatttgcgactgggtgatcctgaaacgcagatcttattaccacaactacagagtgatttttatcaagtcatcgtcgacttattgcaacatcggcaaccacacgcgcagtggcaaacgacggcaacttatcttggcgtcgtactagctgctcccggttatccgggaccaactgaagccggtgtaccggttccgacggttgctggtgcggattatgctagcgttgcgggtaccccggatcaattggtcagtgcgggtggccgggtgatgatggttaccgcaagtgccccgagcttggtcgcagcacagcgggctgtttatcaacaaatcgaccaactcagagtcggtgatctagtgtaccgaactgatattggcgttaaggggatgacagcgtcccacgattagcgcttgacattcggtgagcaccattctatgctggaaacattacttaaattcgtcataaaagaataatggttggtgttggcagttaaaggctgacccaaacgttgaaatcgtcctttttaagcagtaggggacgatttttatattggcagaatgcaattaatttggaggctaaacgggcatggaatttggcacattgatgatgatggttaggcaccgtgtacatggttggcaaatggcaatgcggtctcaaaaagggttgcatcggggcacaacaacgctgaatattaatgcggcgggacttaaacggatggaggacgctgcttttatgcatcatattcggaaaccggttgataagccgcataatctaaattggtggcactttaactttttctgggggctacaaggcatcacccaatccgggataggttcggtaccggcgctcgcgttgaccggtaaaatcagtggcttcaaccatcctgccgttgcgcattttgaattcatgcgcaatcaaatcagtggtggaactgtggataaacaaatcttgcccgctcccgagctgtgcttggcagaactcaaacggtccgataatgcgcgcgcacttaatcgagtctatcaatcagatacggaaatggtgcatgacttggccgcagcctaccaccagatcatgagtgacttgtatcgagttggtgcgcggacgattcagctgaatcgccagggcctcggcagtcagcaagggcgatcaattactgaacttggcacacaggtaagtcgtgaggccgttcgtgatttacctgccgatctctgtgttcagtggcacgtgacacatgggacctgttactcagcgtagctagtcacagggtggcctgggcagctccgtttgcatagctaagaaaacgatcaaaagggattaatattaaaacgtgcacttacctgagtcagttatcactcaggtaagtgcacgtttttggttgggctggttgcaagttctcgcaccagtagacccgttatcgattattgaaagcgttaatagcgacaccgttttactttttaccctgcaatgactgtcgcttcgggctgacccacgttccggagccaaagcccagaatggttttgagtgcaggaataaacgttgcaacgacggtgataggattgatcatccagtaaaataacatgtagagtggggcgaagaaccagtactttagtttcgcaccatgatggtccaacaggagtgccgctaacagttgcatgaacccggccaatagttcaaaactaacaaagacaaatgacaacatcaagccgtggtagactcgttcaaaattgccggttatcaggaagtaacccatcagaatcaaaaacatcaaggaagtgatgacgaagaaaaaggaccagatgattgacaacgtcgaatcgacgaacattgatagttgatagcgatgaacgattgggtggaaaatgaatttcttaatgttcgttaaccacacttccgtgccaccctgtgcccaacgtttgcgttgatgataaaggtctcggattgtggtggggacgttcatatggaagacgatgttaggggcaaaccgcgggacggcgcccaccatttggtgatcccaggcaatactgatatcttccgtcgcgcgattttgtcgaaagccaccaacgtcaattagaaattgtttgcggtagagggtatttgccccgctatacgcgtacatagagtcgttgatggaagtttgactccgcttgataacaccgacgatactagagaattcaacggtttgagatttacctaaaagcgacgttcgattttgaacatccatattggcggtgacggcggatgtattcatatcgcggtcatggatgaagaaattcatatacttcatcagggcgtccttttctggaatcgtatcagcgtcgttgctgagaatatactcaccctgggcaaagtacatgccaatattgaaggcgtgggccttgcccttgtttttctcaatttcaacggttcgtagccgtggatagacggactgcaaccgttgaataatggtggccgtcttgtcagtcgaaccatcgttcatgactaggacctcgtagttcgtataattgagctgggtaaataagtatgtgatggtttcttcaatcatgacttcttcgttgtgcgccgggatcatgatggtaatcattggttgctgttcagccggaatgtactgccagtcatcatcacgcttattggtcttgataaagcggtaggatagcgcgccggcgaaccagaaaaaagagccaacgatggggtagaggcataaaatcaggagtgcgatgttgattaccgatttaaataaggttgcggcgaatatgtggtcaataaaaatatttgtcatggcgccccctggttaatcgttaatatcgtctaaattattttgttgataaagttgctgaatctgattagtatcgagattttgttctggcttgacccggtagtggcgggtatgttcacgaaattcggcattgccgaaacggtccgccatgaactgagcgagcagttgctgccgttttttctgattaatgggattaaaggttggccactgttcaacgacacgttcacgcttacgattctgtataatggtcatggtcactgcaaaaagggatgcgagtgcaaagcaaaaggccagtaagataccgatgaacttaaattcgaaaagaccttcatggtagtgccagaaacgcggaatgtgtggattataacttgaccaaatggaaaggactgtcacggtgatgggcacaatcactgcgatccaacccacgataccaacgatcgtttggcgaatcttgagtccccaatggccagtgtcaaagtacgcatcagagtatagttgttgccgattaacatcatcagtggttggtttaggcatcgtggttctcctttgtggttgattgctggggattgattggatggccgaataagtagccttggcgaatgctgatttgcagttgctcggcgagttgttcatcggcctcattttcgattcccattagaattagatcaatattgttttccttagagagctgattccagaattggaggttcaggtccagccagacggatgggtcttccttgcgaaatgagcgcattgagcatttgagcgtgtcgatatcttttaaaagccactgaatgtttttaagattggctagacttgcaccgacgttatcgattccaaactgcatgccgtaaccgcgggcttcacgaattcgtcgccgaaataggcgtttattgatacgacgcggttggtattgaggtgtgtactcaattgccaagtgcatcggttcgatgttcgcaattgcccagcgaacaaaataacggaattcgggactgatgatttgttcgtattctaaattgattgataacgtaatcgcttcatcaggtagcgccttaaaggtatcttcaagcaggaagatcacccgctgaagtggaagtgagtcaagttgtggtggtaatgaccacgaaccatcagtattttgttgacgcaggagacattcatagccggtagtgcggccacgaaaatcgacttgtttttgaataaagtagcgtagattaaaatcatcattttcaaggtaattgttggaacgtttgcgggagtaccaataataagtaccaatcgtcaggatgaagatgaccgcaattgagcctgtcaaccacagtaatcctatttctaattgtgctagactcatctaatataatctccgtaagaaaaacttatggtaacaggaaagacgactaaccgtcgtagttgacagtgtcaaacattttgacattataggcctaattttgcacagtttcaacaaaaattatctcttgataaatagaaatgatttttgattaacgttaatcagtcctgtcttatgaacgaatcacgcaaccgcacatcaacactgtttagccaactaaaccaccagtgattgacggggttttagtggtcgcttataatcgataatgactttgacggataatttaataagtatagaagagggttatcataaaatgaaaattgttttaacgggttcaatcggtcgtattaaccagaccttggtacctaagctgacccatgctggtcatgaagtgacggtcatcagtcatcaagcaactcgcagtagtttgataaaggtttttcgcgcaacccctgccattggtcgacttgatgacgaagcgtttttgaccaagacgttcatgggcgctgacgtggtatacctcatggtaactggtatagcggcgagtgatgatctttataccgctgccaaacgacaagcggacatctatgccgccgcgatcaaggcagccggcgtaaaacgagtggtgaatctgagtagcgtgggggccgacttgggaccagaagtcggtgcactttacatgtatcatattatcgaacaaacgttaacaaccgctttaccagacgtggacttaacgtttatccgcccaacggcaatgtactataatttactgagcagtgtgccaaccgttaaaaagagtcatcgaatctacacaaatgccaatttggctgttaagaacgtgtgggttgcgccggtcgacgttacaactgtactgattaaggcgctgaccgaaccgacaccggggcaaacggtgacatatgttgcgagtgatgagaaaacttatttggaagttgcttccgcactgtcacaggctcttaaaatgccggatttgcgcgtttcacaagtgcctgatgaggtcatgcaagatcatttagtgactgccggaaccccggtcgcatttgcacgggaatatgttaaaacggtcgcttaccagcgtgaccacgatttttacgcggattatcgagcacatcaacctcgattaggcgatgttaaacttgctgactttgcccaagtctacgctgaagattaccataatcaacaagttcttaaacactagtaggcgttagatgcagccgtgcctactaaaaaacacccctgagttaaagactcaggggtgttttagactgccatcattgcttagcgaaccatcagttctaagcgacaaatgcaaagtagagaatgaagacgaccatcatcgtccacatgagggcgtttacttcacgccaacggcctttgaccgtcatggtgattgggtagaagataaagccaacggccaaaccttctgagatactgtaagttagtagcatcataatcatggtgaaaaaggctgggacggcgatttcaaacttggtccaatcaatatattgaacgtttgataacattaaaataccaacgataatcagggctgaagcggtcaccgcggacgtaatcaccgtcaaaattggagagaaaaaggcggcgatggcaaacaagagggcaacgaagacggaagataacccagtacgggcccccacggcaacgccggaagtcgattcaacataagccgttgtcggtgacgtgccaaagactgctcctaaagttgtggcgagtgcaccactaaagagcgctttaccaacgcctttgacttcgccggattctttgtccaccatgccggcttcggttgccaccccaaccaaggttcccgacgtatcgaaaaggccaatgatgaagaacgtcaggatgacaatgatcatttgaaacgaattaatattaccaaggtgtgtcacggcttgaccaaaaatcggttgaacgctcggaaccccactgataatcccagttggtaggggaataatcccgaagatcattccgactgcggcggtgatgaacatgccccagaaaataccaccagttacattagcggtgactagcatgatgccgacgataatcccgaaaatcgccaacaaaacggtgggactgtgcaagttacccagggcgaccgcgttggacttattcgcaacgataatcccagaggtttgtagtcctgaaaaagcaatgaacaagccaattccggcagatacggcgtattttagcgcacttggaatcaagttgatcagtttatcgcgtaacttggagagcgttagtaggatgaaaagaattccggcaacaaagactcccgccaaagcggtttgccaaggaatgtgccattcctggacaactgtataagtaaagaaggcattcagccccatccccggtgctaatgctacgggaaaattggcaactagccccatcaagagacaaccaacgatggccgctaaaatcgttgcggtgaagacggcggtcttactcataccagtacttcccaatagttcgggatttacggccaaaatatatgacatggctaaaaaggtcgtcagaccaccaatcaactcgcggcggactgaagtgcggttttcacgcaaatgaaataattgttctagaataatgacccactcctaaaattaataaaaaactaacaattcaacaattgtctagtataacatactgatttttagggtaacaggggattaatcagtttattgcctcacgatggcttgtttttggaatggaccaggtttagatgactcttcggcagcatgggcaagttttatgccaagtcgaaagaaagttactttaaaaaaagtcttcatcggtacgacgcttgacattcagcaaaaaatggcagtataaagcaatcaatagaatgagagcggctattaagtagcagaacaaaaaaacagcggttcactgccagattaggaccgtgaaccgctgttattaagcgtcataattaaggttgttctgtttcattgagaccgactgattcatcatcaatcgtgttttcggctgcgtggcggttgaagagtaagttaaggccaactgcggctacactaccaacgaccaccccgttgctcaacatgatttgaagtgcaccaggtaagaattggaagatattggtttgcaccgtgacgcccaaaccaagaccaatcgaaacggctgccacgagtaaattattgttattgcggaaatcgacttgagctaacattcgaatcccttgaatgccaacgatcccgaacatgacgaccatggcgccaccaagtactgggtcggggataatcgtcgctagcgcaccaatcttaggcagtaggcccaatacaactaagaacgcagcggaaaagtaaattggctttcgcgtcttgacaccagataattgaacgacgccgacattttcagaaaacgttgaataggggaaggtactgaacaagccaccgaggatgacggcaattccttctgcccggtaaccacgttttaaatcgtcgccttcaattttacgaccggtaatgtcgccaagggcaaagaagaccccggtcgattcaaccatcgttgttaaggagacaaggatcatggtcaaaatggatgaccattcaaagtgcggggtcccaaagtaaaagagggtcggtaaatggaaccagctagcttcagcgacgggttttaaagaaaccatccccattgccccggcaatcaaagtcccaactaaaataccaatcagaatcgaaacggatttcatgaagccacgtgcaaacacgctaattaataaaataattgcgatggtgagaaaaccaatgccaagtgcttgcaagttaccgaaatccttggcactggtgtcgccgccaccaagattttggaaggcgaccggaatcagcgtgaatccaataatcgtgattagcgatcccgtaacgactggtggaaagaggttcttgatctttgaaaataagccggcaatcagaaaaataaaaataccagcaccaatgattgagccatacatggtccccagcccatatgttttaccgatttgaatcaacggattgacggcttgaacggcacagccaagcacgacgggaagcccgattcctgttagtggtgtacgttttaattgtaggaacgttgcgatcccacacatgaaaatgtcgattgagactaggtaagttaattgttcttggctgaaatgcaaggccgcgccaatcaataatggcacgagcacatcacccgaatacatagctaacagatgttgaaaccctaaaatggccgccttaacattggtaattttaggtgctgcggatacttccttcaaatcaatcttcctctctcgattaagctgatttgcctataaaaaaagtcaccccggcaaacgggatgacctcgtttgcttatagtccaacctttacggggttgggtagaaactcgtcaaccatatcatgacattatataggcaattaccacttatttgaatgagacttattctagcacagatgaaaaccgaatacaaatgtagccgaataaattaatgttcgtgaaaacgatatttttttggaagatgaaaatgaaaacgttcacttttgtgattgttgattatgccaaagtagcactgccatttctagtgtttgggtctgttcaggatcgtccaagttcaacgttagcattttttcgatctttttaaggcggtaaatcaccgtattgcggtgaatatctaggtggccggccacttcggcaatgttttgatggtaataaaaatagccatacagggtcgtgagtagattaagttgttcattcgcactgacaccactgacgagtccacctaagacccgttcgacaaacgatcgcgcttcattttgtggaatcagtgaaattagttccttgacgtacttgggccgatagatcgtgactgcgtggggactgtttttgctgagtgccaaggcttctgccgcttcattataggttgttgcgagttcggttagtggtagagtcgaataactgtaaccagcaatcaaacgcgcctgtctgtccaactttggctgaataaattgaacgagggcggtcagaaagtgctgggcattttgctggtcattgattaataagaccaattgctgctttaatgaaaaaacaatgacggatgcttggtattctttaataaaccacagtgtcagttgctgaacctgttccaagagatggttacttaagagggcctggtgattagtcgtgactaaaatggtggcgcagtggaacttcgtactcggatcaatattgcgggctttcagagtcttattcacgaggtcgtttgaaataccgccatccattacgtttaagtagaaaccactttggttgcggaatgcggattcgtttaacatgtccacccgaccattgacgaaactcaaggtgtttaagacgacttgcgtcagcatctgatcagttgagttggccgggtccaagtcgacgacgcctacaaaggccttattttccttataagccgaaaatagtggcatgatggtcaggtcatttgcttggtaagggagaatgacgcgggtattgaggttgaaatagtcgatatcggtttgattgcgtaaaaaatcagtcaaggtattgcgggtcatcggtaaatcttgggaagcactgaccacccgaaaatgactatccattaagaagagaggatgatgaattagctcgctacatttattcaagaccgtggtgttggttgggtctttgagcaacaaatccgctagtgtttggtttgccttgacgatgcgactgagctcattagtttgtgactttaagatgatgctcagcattttgcgcatggtttcagaaatcaactcatcaccgggcgtaataatgattggaaaagcgagttcgttcgctaattcaatcactttttttggtaaatggtcaacgtaacgatgatccttaaatccgagaccagcacagttggcattgtgcatcgccttgatcaaagttagtgggtcggtggttgtattgacgaagggatagccgttcgtaatcaaaaactgaccattagcaaggtagtcagcaatgtcaggtgactcgatcattccgatattactaatttcgcgtttgagaccgcgttcacccgcaattacccgcatatgttgcattgatggtgtttgtaatagtgtttgtaaacgcatggtaagccccctaaaattagttatctttaacaagtagtataccgataatttggcagtttgactataattaaatgaaaaatagattaaaaacaaatgaagcgtcgaaccagtgttatgggttaaggaatttaagtattggaaaggtttatcctcatttaagcgcaggagtagccggcgcaggactgctgaagaaagttttgtttagtgtaaattcacctggttagggcgttggatgccgacatacagaaacggggttcgctcgggttgagacttccagttagctaagtgaaagttcacccctcaacgttgccgttgagataatcttcagtttcaacccgtctgaacttcaccggcttccagtgctgagtattgtcagcaacgcctttcagtcgaggtggtgttcaagtgatgggtggacttaacttttgctgagtttgttgttgctcataaagggtagatttcgcatataatgatattttgatagaccatttgttgctaaattagcacgttaagattgaaacagtcattaaagtgaattgatggtctcccagctttaattgaagttctaatatcaacggattcaacgaccaatggtactaatattaggcgaccgctcatcatttattcttagaggccggaataagacgatcacgtgtcacgattggaaatctattgaactcgccaggttcctcaatgatgcttgtcaacataaagggcaaatgaccaaagtcgtcagataattaacgcgacttaagttgattagtccttgacagttgtggtggagttcgttacacttagtccaattaaacaagcacctttaacttagtcctgtgaggctaacaaggggaacggtcatgtagggtctcccacgcttttcgcaggaaaacggggtgactctttttttaccccgtggattaaggtgaaattacagaaatggagctgacaaactaatggcacgagaagtcgttgatgcaatgaccatgcgccgcgcgctgacgcggatcacttatgagattattgagcagaataagggtgttggtaacctggtatttatcggtatcaagactcgtgggatttttttggcccaacggttagcgcaacgattgaaacagttggaaggcgttgacgtgccagttggttcgttagatatcacgttatatcgggatgatcatcatgcggttgatgttgccggtcaagcgaagctaaatggtgctgatattccggttgatatcaatggcaaacacgttatcttggtcgatgatgtcttatttacaggccggacagttcgggctgcgctagatgccttgatggaccatggacgtcccgcaaagatttcgttagcggtcttagtcgatcgtggacatcgtgaattaccgatccggcctgattttattggtaaaaatattccaacggccttggatgaacaagtcagtgtcgcccttgaagaacacgacggacatgatggaattagtattgaaaaattagaagaatgatttaattgaataaaaccatttaattgtttccagagaggaacgaaacggtttggtcatgcgtgaccacttaatcggagtctagcctctttgcaaacatttttgcggaagctagactttttttatatacaaaggagacggcaatagccatgaaaacgagtcaaaacctagttagtgttgaacaatttagtaatcaggacgtgatggcctacttgaagttggcccaagctttcaagaatgggaaaacggtacaactgtcgcagccaacgtttgcgatgaacttattttttgagaatagcacccgcacacatacaagttttgagatggccgaacgacgattaggattacaggtgattccgtttgacccaaagactagttccgtgactaagggcgaaagcttgctggatactttgaaaacgattgaagccattggcgtcaacttggcagtggttcggcatccacgcgatcgttattatcaaccacttctcgacgccgggtttgacatgagtttgatcaatgctggtgatggtagtgggcaacatccgtcacaatcgttgttggatatgctaactatttatgaagaatttggtcattttgatggtttaaagatagctattgtgggtgacttggcccattcacgtgtggcccgttccaatatggcgttactgacgcaactaggagcccaggtttactttggcggccccaaagaatggtatggccgtgactttgaagcatacggcgaatatcagacgatggaccagttagtcgcaacgatggacgtcatgatgttattacgtgtccaacacgaacgattatcgcaagtgaacaatcagaccttcgatgcgtctgcctaccatcaacagtatggtttaacagctgagcgcgccgcacgaatgcccaagcatgcgattatcatgcatccggcccccgttaatcgaggtgttgagctagcgagtgacttagttgaagcgccgcaatcacgaatttttcagcagatgacgaatggtgtttatattcggatggcaatggtggcgagcgtcctcgctcatcaaggattaatttcagcaactcaagtggaggtttaacgcatgacaacattaattaagaatgctcaagtgtggcaagcagggcagttacaaacaacggatatcctgattgccgagggccgaattaaggcgatcgggcatcaactgcacgatcagtttggaccggcggatcacgtcatttgtgccgatcagcactttgttagtccgggctttgtcgacgtacacgtccatttacgcgatcctggtcaaacagcgaaggaaacgattgcgaccggaacgttagccgcggcgcatggcggtttcacaacggtcggagcaatgcctaatgtggatccggtacccgatacacctgagcgggtcgcgacgatggtggcgcgtaatcagcaggaagcacatgttcacgtcgcacaatatgccagcattacgactgggcggactagtgaacagctcgttgactttgccggcatcaaagctgcgggggcctttgccgtcagtaacgatggttccggtgttcaaacggccggaaccatgtttgcagccatgcaaggtgctgctaaagttgggttgccattagcggcacacgttgaggatgattcgctttatcatcatggcgtgatgaacgcggggcccgttgctgatcggctaggattgcctggtatcaataatgtttcagaagcggcccaagtggctcgtgatgtcatgttggcggaagcgagtggggttcactaccatgtttgtcacgtctcaacggcggaaagtttacgcgtgattcgcaatgcgaaagcagctggcatcaacgtgacttgtgaagtatcgccccatcatttactcctttgtgatgaagatattacgatggataacccgatgttaaagatgaatccaccgttgcgttcagccaaggatcgcgcagcgttagttgcgggattgttggatggcacgatcgacatgattgcgacggaccatgcgccgcatactgatgccgaaaaacagggcagcatgaagacggcagccttcgggattactgggattgagactgcctttgccacgctatatacggcgctggtcaagacccggttactgacgctcggtcgtttaattgaactgatgagcacgcgtccggctgaactatttggcttaaatacagccggccggttggtagtgggggcaccggctgatctaaccattattgatttagatcatcaatatgaaatcgaagcggccaccatgttatcgaaggggcacaattccccgtttatcggttggcccgtttatggcaacgtcttaatgacactagttgacggtaagttggcatatggaaaggaaacgcaagcatgaaacgatacttagtacttgaagatggtacgatttaccccggcacggggtttggtgcgacaacggccacggttggtgaattagtctttaataccggcatgagtggttatcaagagtcgatcacagaccagtcttataatggcgaaatcttgatgtttacgtatcctttgattggaaattacggcattaatcgggatgaccatgagtcaatcaagccaacttgtaagggcgttgttgttcacgaagttgcccgacgagccagtaattggcgtaatgctcagtcgttggacgattatctaaaacagaatgcgattcctggcattatggatattgatacgcgggcggtcactaaacatatccgaacgaagggcgcgatgaaggccaccatcgtcgataacgtcttaccagatacggttgaccggctcaaagtcacggaattaaatcgggccgttgttgcccagagctcaacgaataacgcctatcccaacccagcgacaggtcccaacgtggtcgtcgtcgactttgggttgaagcattcgattttacgcgaattagcaaagcgtcaatgtaacttgacggtgttgccgtacaataccacggcgagtgaaatcatggctttgaatccggatggtgtgatgttgacgaacggccctggtgatcccaaagatgttccgggagccttagagatgatcagagaagtggaaaaacatgtgccgctatttggaatttgtctcggacatcaactttttgcgctagcaaacggtgcggacacgttcaagatgaagttcggacatcgtgggtttaaccatcccgttcgtgagattgcaactgggcggattgattttacgtcgcaaaaccatggttacgcggtggatcgggattcattagcgcagactgacttgttaatcacccatgaggagattaatgatggtaccgtggaaggcttgcggcatcgcgactacgcggccttttccgtgcaatatcatccggacgcagcgccgggtcctcacgatgctgatcatatttttgacgaatttattgatttgatggcggctaatcaagcaacccagaaaggaagccaattcaatgcctaaacggacagatattcataaaattatggtaattggttcaggaccaattattattggtcaggccgcagaatttgattattctgggacacaagcttgcctggcattaaaagaactcgattatgaagtggtcttggtcaattctaaccccgcaacgattatgacggacaaagaaattgcggaccaggtctacttggaaccaattacacttgaatttgtttcacagattctccgcaaagaacatccggatgcgattttgccaactttaggcggccagcagggcttgaatatggcgatggaattatctaaatcgggtattctcgatgagttgcacattgaactgttaggaacgaagctcagcgcaattgatcaggcggaagaccgggaacagtttaaggcactgatggaagaattgggcgaacccgtgccagcttctggtattgcgcggacggttgacgaagcgttggctttcgctgagcaagctggttatccggtcatcgtgcgaccagcctttacgatgggggggactggcggtggcatcgccgagacgccccaacagttacacgacattaccgaaaatgggttggcgttatcaccagtgacccaagttctgatcgaacaaagtattgccgggtacaaagaaattgagtttgaagttatgcgtgatgctgcggataatgcgatggtcgtctgcaatatggaaaattttgatcccgtggggattcataccggtgattcaatcgtctatgcacctgttcaaacgttagcagatcgcgaagtgcaattattacgggatgctgctttgaagattattcgggcgttgaagattgaggggggctgtaacgttcagttggccctcgatcctaatagttttaattactatattattgaagtaaatccgcgggtcagtcgctcatcagcgttagcctccaaagcgactggttacccaattgctaagatggctgccaagattgcagtcggcttgcatttggatgaaattaaaaatccggtgacgggaaccacttacgctgaattcgagccagcgttggactacgtggtttgcaagattcctcgctggccgtttgataagttcacccatgctgatcgtcgtttgggcactcagatgaaggcgaccggcgaagtcatggcgattgggcgcaatattgaagaagccacactaaaggcggtccgatcactagaaattggggtgcaccacgttgaagaacccgctttgcgtagtgttgacgatgatgtactcagcgataagctcattcatgcgcaggatgatcggttattctacttaacggaagcaattcgccgtggttacccgattgatgaattagccgaactcaccaagatcaacgtgttcttcctggataaactattacacattattgaaatcgaacaagccttgcgtacccatacggatgacatagagacactaactgtcgctaaacgcaatggcttcgccgatcaaacggtagctgactattggcacgaaacaatcgatcaggttcgcgacttccgcttagcgcacaaactagcgcccgtttataagatggtcgatacttgtgccggtgagtttgcttcggagacaccttattactacggcacttatgagtttgaaaatgagagtattgtcacgaaacgcccatccgttttagtgttagggtcagggccgattcgcattgggcaaggggtggaattcgactatgctaccgttcactccgttaaagccatccaaaaagctggctatgaagcgattatcatgaatagtaatccggaaaccgtctcgactgatttctcagtatcagacaaattgtacttcgagccactgacgattgaagatgtcttaaacgtgatcgaacttgaaaaaccagtgggcgtgattgtgcaatttggtggtcaaacagcgattaacttagcgaaaccattggctgaccatggtatcaaaatattagggacgagtgtggcggatgtcaaccgtgcggaagaccgtgacgaatttgataaggtcatcaaagctttagctattccacaaccggctggtgatacggcaagtgatgaagcaaccgcgctagctattgcggataagttgggctatcccgtccttgtccggcccagttatgtccttggtggccgggcgatggaaattgtcaagaagcggaccgacttagactattacatgcataacgcggtcaaggtgtcgcatgaccaccccgttttagtggacagttatttggtcgggaaggaatgtgaagttgatgccatttgtgacggtcaaacagtcttgattccgggaattatggaacacatcgaacgggcgggtgtccattctggcgattcgatggccgtttatccgccacagtcactttcggcggcggtccaagcacaaattgtggattatactgaaaaattagccattgcgctcaactgtgtcgggatgatgaacattcaattcgtaatccacgacgaccaagtttatgtgattgaagtcaatccgcgcgcgagccggacagtgccattcttaagcaaggtcacgaacattccgatggctcaagttgcgactcgggcaatccttggccagtcattggctgaacaaggttatcagactggcttggtcacaccgggtcccttagtacacgtcaaagcgccggtcttttcattttcaaagttgaatcgtgtggatagtttgttgggaccagaaatgaagtcaacgggtgaagtcatgggcagcgatgtcacgatggcaaaggcgctttacaaagcctttgaagcggctaagctacacgtgccgagccatggtaacgtacttttgactgtccgggatgaagacaagccagaaacagtggcgttagccaagcggttccatgcgttgggctaccaattgctagcgactcggggaacggcgactgctctgaccacacacgggttacccgttacgaccgtcgacaagatcgatagtggcgagcatgatttactgcatcgcatggaagctggcgaaattcaagtcgtcattaatacggtttcggatgaagaacaggctgaaaatgatggtaccctgattcgaaacacgtcaattatgcacggtattccattgtttacggccttagatacggtcgcggcaattttgcaagtacgagaatcacagtcatttgtaacgcaggcgctctaaatcaggacacccgccgataagcttgatcataggaggaaaacgatgggacgattaacagtaaatttagccggtgtcacgttcaaaaatccggttatgccggctagtggtacggcggcatatggtcaacagatggctcaacagttagacctgagtgcgttggggggcttggtcatcaagtcgaccaccgccgaaccgaaagcgggcaacccacgaccaacgaccgcggaaacaaccgcggggtggctcaatgcaattggactcaaaaatcccggaattgacaatgtgctggccgataaattaccgtggttagcgactcattatccggatttaccgattattgggagtgtcgcgggggcgagctttgatgaatacgtggcagtcgcacgaaaaatggcgtcggcacctaacgtcaaattattggaaatcaatatttcatgtccaaacgtcgaccatggcggcctagcatttggaactgatccagcgacggtaacggcgttgactaaggcgattgttgccgcggtcgataaaccagttttcatgaagctgaccccgaatgtcactgatattgtcccaattgcactcgctgccgaagctggtggagcggctggactgacgatgattaacacgttaacgggtatgggcatcgatttagccacacgtcaaccgatcttagcgcatggtacgggcggtttatctggaaaagccattcatccacttgctgttcggatgatccatgacgtgcgtcaacataccaagttgccgattattggcgttggtggcgtgttcacgccggctgatgtgttggaattttacctggctggtgcaaatgctgttcaagttggggccgcaacgtatggtcacccgactgcttgtacagacattattgctggattaccggcggcaatggatcagtacgggatcaccagcttgcaagcgttgattcaggaggtccaaggatgaagcgaccaattatcattgcgttagattttcccaccgccgaacgggccttagcttttttagaccaatttccggctgatttacatgtcactgtcaaaatcggcatggagttattttatgcagcgggaccgagtattgtgacggacgtgcaagctcgcggccatgcggttttcttagatttgaaactacatgatattcccaataccgtcgaatccgcaatgcgggtgatcgggcggttaggggtaacctatacgacggttcatgctgcgggtgggcacgtgatgctttcagccgccaaacgaggattggtcgcgggtgcaatggccgctggagtcactgcccccaagttattagcgattacgcagttaacttcgactaatcaagctattttgaatcaggaccagcaaatcatgggaacggttcgggcgagtgtcgtgcattatgccaaactagcacgggcgagtgactgtgatggcgtcatttgttccgcccaagaagttcaggcgattcatacggccgtcggtgctgattttctcggaattacgccgggaattcggccagcgtcggcgcagtcagatgaccagcaacgggtgatgacaccggctgccgctgctaaggctgggagcaacggtctcgtcatcgggcggccaattacgcaggctgcagaaccagttcaagcttaccgagatattatgacagaatggagtaactaatatgagtgaaattgcagcaactatcgccactgatttgttgacgattaaagccgttacactacgaccaaacgacccgttcacctgggccagtggcattaaaagtccaatttatacggacaatcggctgacgatttcttatccggcggtccgtcagcatatcgcgcacggaatcgccgccatcatcaagcgtgaatacccggcgaccgaagtgattgcgggggtcgcaacggctggcattccccatgcagcctgggtggcggaattgttaaatctaccattgatctacgttcgtgctaaacccaaggatcacggtgctggacgccaaatcgaaggagtgttaaagcccggtcaaaaagttgtcatgctggatgatctgatttcgacgggtggcagtgtgttacaggcggccaaggccgttcaagcagcaggtggcgatattcaggctgttggggcaatcttcagttatgccttggatgcggcaacgcaaaattttgccgctgtgtcattaccgctgttcagtttgtccaactatcctgaactaatcaaagttgctcgccaagcagattacattgatgacgaggaattagcttcgctgcatacgtggcgtcaggacccagaacactggggagtgactgattaggattacgcgccataaatggctggcatatttaaaatagtcatgaaaattaagctggattatccagacgattttcatgactattttagttaccggctcgtgctaatattaacctgtgacagattgttaagacaagataaagaaatgagggaatattcgatgttagcaattttagttggcttagcaatcgggattgggttaccaatgcaaacgagtattaattcgcgattgcgcaattcagtgggatctccatttggtgcctccctaatatcttttgctgtggggacgttgtttttggcgataatgacactaattgatgtccatactttaggattttcgacgacgttatttacgagtcaaccggtttggatttggctgggtgggctgttgggggtcgtctacttaactggcaatatcttgttgtttccgaagctgggtagtgttcaaaccgttattatgcccgtgcttggtcaaattttggccgggctattgattgataattttggttggttcgactcaccccaaagtacattgacgatgacccgatttttgggtgcaattttagtcttggcgggagtcatcatcaccgttgcggctcaggggtggctcgaacagcggcataatcgaatcactgaaacagcggaaaaagatacagctactgacactgaccaaagtggccttggaatttggcgtgcactaggtgtggttgccggaatgctcagtgcgatgcaaactgcggtcaatgggcacctaggtcgggtgcttggctccacagtgcacgcggcatttgtttcttttttagttggtactctggggctgatcgtcatcgtgttagtcttgcgacctcaattcaaattgattaggccaactaagacgcctaatccttggtgggtgtggattggtggcatgattggcgcgctgtatgttttgggtaatgtttacttggttccggtcgttggcactggtttagcggtcgtcattgttttagtcggactgatggccggtagtttaatgattgaccaatttggctggtttgcttcaaaaaagaacccaatttcgggggtccagttgatgggcttgctcgtcatgattgtgggggttgtgctaattcgcgtcttttaagcactctgaggattggcgagtgtcaccgggtgatcggtaaggtgttttgaggtcgagacttgcagccggatgaataagcgaccgtgcgagttgaccacattaagccgtgaccacgttcgttaaagcttctaaaatttcaaatcaggatgacaaaacggtactggatgccgggcacgataagccattataaatccgacgcacatctggcagcagtggccgtcaacgttgagaattaagacgtgcagcacacgggtcgcctggctgaataacgtggtatttaatggacgcgataataaacatctaacttacgggttaggtgtttttttagccggttaaatatgcgataatgagactaacttaatgagaacgtttgttcagttcagaggaggaattagtggtgagcttacaatttgtattgggaccagccaagatggaccatcgccgtactatggtggcgcagttagtggcaaccttgatggctaagccacaagatcagtttttttatttggtaccgaaccatattaagttcgatactgaagttgacgtgttgaaccgcttggcacaggcatttgggcaaccagatttgtatgcccagactcaggttcaggtcttttcatttacccgtcttgcttggtacttgatgaagaacgaagcagcttatcaagtaccacgactctccgctgctgggattgacatgctattatatcgcattctacaacgacatgccgatgagctgcgattgtttggtggtgaaatctcgcaaacgggttttgtgactcaactagctcgtgaaattaatgagttacagaccgctaatttgcaaccagaagatgtggttcaattggcagcgaatgctcaggcgggtgacttgcaggctaagctacatgatctggcgatcgtttacaaagacttcgtggcggcgactgcagataagtatcttaagcccgctgatattctcgttcaattgaatgcttacttacggcgtcaagacttgcacggaacgcacgtttatgtggaactcgctggctttgcccaattaccggcccaggaacagggaatcgtcacgactatgctggaacagggcgcggacgtgacaatcagtttgatgctcgatcacaaagtcgttgaccgggcgccagaaaatggcacgctgttttatcaatctggtcggctttattatcggctttatcagtatgcccgtattcgtcagattccggttagccaagatatttatgctgaaacgccgcgcgtggctcccggcttagtggctctcgatgatttttggcgtggtcagccccaagcggctaccggttacgaggagccgaatacgaatgtgcatttattccggaccgatagtcgacagaccgaattggcacaagttggccgcatgattcgggcaatggtcgcgaaaaaacatgccgatcccgccgacgattatcattatcgggacttcttgatcatgacacggcacttagatgcctaccaaacgatgttagcgccgacttttcatgaattagaaataccatactttgttgatttacagcgttcaatggccgaccatccgttagttgagttgattaacgcgttgtttgatatcgacgcacagcagtatcaatatcgtgatgttatgcgagtgttgaaaaccgagctgttgatgccaaatatcaatgggcaaccgatggatcggcaagcctaccgccaagcagtagatctgaccgaaaactttatccttaaaagtggttatcacggccagcggtgggtacaaagggaagattggcaatactttcaattaaccgagggtgatgccggggtcgagacggaccaaaatgctgaaatttcgcgacaaatcaacttgattcatcactttgttgctgaaacgttaccaccgttttttaaaaaaatgcggcaagcaccggatggcaaagcggccgtgacattgctggtcaactttttgacaagccagggcgttacggaccagctattagcttggcgtgatcaagccttggatcgccaagatgtccgggcagctgccgagcctgagcagacctggcaaactttctgtgggatgctagatgaatacgtgacgattttaggtgcagagccatttgaaattacggactttttggcactattacaagcgggctttgaaggtgctagttactcgcaaattccgtcgacgttggaccaggtgttaatttcagagagcggaatggttcaaagtcaggaccataaagttgtcttcatggttggggcaaccgatttagtgatgcctgaccggattatgacgaacaacttattgagtgatgtggataaagaaaatttgcaaccaacgctcagttcgttagatggtgaccactatttaaatgattcagctgtcgttcagctcggtgatgaaagttgtctgaattatttggcctttttaagtgcccgtcgacacttgtttttcagcgccccgttaaaagatgatcaagaaacagatttaaattggtccaactatgtgcggcgaattcaacgccagttcaatttgcgagaacatacttatcttgggacgcctgatccgactaatgccgatgcgcggccatttgttgggactaagcgccggacgattagtcatgtgattcaggtttaccgcgatgtgttaacgacgaatactgaccgtaatcgtgttggcgcaccattacaacctgctccggtgtgggtgtggttacggcaacaattgacgcgtgatccccaattcggtgagctagcacgtcaattgatggctggattaagctatcgcaatcaacctgtcaagctgacaccagccagcgttgaggctttgtatgggcatcaaatttatacgtcaatttcaaaactagaagaattttatcgtaatcagtacgcttatttcttgaaatatgggctcaaactgcgtgagcgtgatgtgttcgagttatcagctgctagtactggggagtttttccacgctgtcttagatgggctcatcaaggcgttacggtctgatcaaatcccattggcccaagccagtgatcagcagttaggacagtatttagagactgtgacccgtcaaatcttagatcaaccacagtttacaattttgacgagttctaaccggatggcttacttgcaacggcagttaatcaacacagtccggcagattgcatttgcgattcgcaatcaaagtaaactgtcagccgctgaaccgaagcaaaccgaggtcttatttggtaacgttggcaaggaacacggattaaaagcgctcgattttcaaattgatgcaacgcatagtgtgcacgtgcgggggaagattgaccgtctcgaccaaattcaagtggcagatcaaagttacctgggaatcgtcgattataagtcatcccaacataaatttgattttcaagaggcttactatggtctcgcaatgcaaatgttaacttatttggacgctgtgctgcataacgagcaagctttagtcggttctgatcaagctgcggttaaattagctggcgcactttacatgcacattcaaaatccaactctgaaaccaaaagatattcagggcggttttgaagcagcactcctaaagaagaacaagtataagggaattttgctcgatgatccgcagttattggaacatttagatagcgaactacaacaaggtaacgggacctcgaaagtttacccattcgcacgtaaaaaggatgggtcgtatagtggggggcgtgcagcttcactggtgacgaatgaccagttagaacgattattacagcataatagtcaattgattattgcagctgctgaagcgattttcgctggagaaattcaactaaatccaattcggctgaacgataagacgactgctttacaatattcgccgtatctatcaattatgcagtttgatgcaatgttggcagaaaatgcttatcgggatctaccgccattatcagccaaacaggttcttgatttactgaagacacagaaaggtggagaaaaccatgagtgagggtacaaactatacacctagccagcaagctgttatcgcacagcagggaaataacttgttagtttcagcttcggctggttctggaaagacgaccgtattgatcgaacgtattatgcgcaagatattggccggcacgaatattgaccagttactcgtggtgacgtttacaaacttagctgccaagcatatgaaacaaaagctggaatcgcaaatcaataagcgaatctcacagttaatgacggacaatccggcgcaaaccacggcgtcaccagcgattcggcaattacggcagcaattaaatttgctcggggtagccaacattagtacgttggatgctttttgtctccgcgtgattcagcgttattactacgttattgatttggatcctgtttttcgcctattgacggacaacactgaggggttactcattcgtgatcaggtttgggacagtgttcgtgaacaattatatgatgaagatggtacgttatttgacttattaacagcgaatttttctaatgatcgaagtgatgatggtctcagtcgattgatttttcggttatttgattttgcccagtcgaccccggatccggaaggctggctgagcaagttaccggaaccttatcaggtggatgaggaagcgttaacggccagtgccttttatcaacaacaattattaccattgctcattaatgaagtcgatgggatgcaaatgaaattacgacaggcacaaaaagttgcgacggatgctgacttagtcccgaaaacgcttgaggtactcgctgcagcacaaaaaacgctgacgacgctccgtgaacaattggcaacggcaagttggaatgagttacgtactcaagtcgctactttcaagattggagctctcaaaaaaacttataaggacgagccggagaagactgcgcgggccaaaactatgggcacatttgtggacggtgtcaagaaacaaatgaccacccttagcgagacctattttgcggccgatgagcagcaagtcttagatattatggtaggggcaaagtcaattgtgactgagctagtggatgcgaccaagcagtttaagacggcttttgcagctgaaaaacggcggcgacacgtcctggacttttcggatttggaacacctaacgttgcaaatcttaacgagtgacaatgaaagtagtcaggcagctttggcgcagttacgggcccaatttgaagaagttatggttgatgaatatcaagatattaactctttgcaagaaagtattttgcagctgttggcgcgcgaccagccaggaaatatgttcatggtgggagacgtcaaacagtcgatttaccagttccgattagctgatccgttattgtttttgcacaagtatcacgattttgggacgaatcccgaacacggggaacgaatcgtattagctgaaaacttccggtcggtggcgaatgtcgatcatttgactaacctaatctttagtcagctgatggacgcgccggtcgggcaaattgattatgatgaagcggcttacctcaagtatgggcccaaggattatccggccgatatgccacaaacgacgaatctattactttaccagacggaaactgacaagtcgacagaagatgtctccacggatgaaaccaatttttcaattgatgatcctgccgttgggagtatcacgatggtcgcccaaaagattttggcacttaaggcccaagataagccaatctatgaacgtgctaatggggaataccggccgtttcgatacagcgacgtggcgttactagtaccaacacgtaatcataatttaacaattattgatgttttcaaacggtatcacattcccgttgtggtcaatgatgcccagaattattttcaaaccactgagattcgaatcatgatggcactactcagtattatcgataatccatatcaagatattccgttagtggcggttctacgctcgccaattgtcggattagacgaaaatcaattagtttatttgcgtatccagaataaaacgagtgattattttcaagccgtccaggacttttatcatcattatccgactggtccggcgactgaatatggtgatcaagtttatgctaagatcgagaccttcttgacacaattgactgaatttcgagatctggcacgacgtaatcaaatcgtaaccctgatttggcaaatctatgaacgaactggctttttagactacgttggcggcatgccggctggtaaacagcgtcaggctaatctccacgctttatatgaacgtgcttatacgtatgaacagggcagttttaagggcttatttcagttcgttcgttttattcgccggatgcaggaaaaggatcaggacttggcagctgccgtggccgagactgatgcggaagcggtcaacgtaatgacgattcatggtagcaaggggcttgaataccccgtgatttttgtgatggatatggataagcagttcaatcagactgatacgcgctcaagcgcgctattggaccgagaagcggggattgggattacttatttggacccagaaacgcttgtgaagtacccgaccttgccacaagttgtgactaagcaggtagtcagcaagaagatgcgcgctgaagagatgcggaaactatatgtcgcgatgacgcgagctcagcaacagctctatttggttggaacaatcaaggatattgataccgcgaccgaaaaatggcggcaggcctttgctagcgacgggcgcgtcttaagtgcccaagcacggattgcggcgactaatcaattagattgggtcggtatggccgtgatacggcatccggccatgaaggcatattggggagatgaatggcccaattacgaattgacggatgatccgaccaagctagccgttgaattgggagatgccaccaccgtcctggcggagcaaagtgaagcggtatcgggtactcaacctgatgcgcttgaactagttgaacagcaagtcaccatcgatgttgatcaagtaacgcgtgattatctgaccacgttactgaattttcattatccacaccaggcttccacgacgacgacggcatatcaatcggtatcagaagtgaaacgaatctttgaagatccggatactccgctgatgaatgcgaacccgactgttagtcagcggcgttcacgaccgacatcccggtttgtgacagggtcactggagttaccacaatttttacaaactacgcaggcgccaaccagtgcggaagttgggagtgcgacccacttagttttagaacaacttgatttgaccaaaccggtcaatgaaacgacggttcaaagtacgattgatgggttagtggctaaccgggtcttaacgaccaatgtcgcgaaattgattgcagttgacaccatcgtggctttttaccagagtgcgctgggcagtcaaattttggataatccggcgaaggtgcaccgcgaagtgccattctcgttactgattccagcacgtcagattttcgatgttgatgaacatgagacgggaaaagtcctgattcatggaattattgacggctatttagaaacggctgatgggttaaccttgtttgattataagacggaccacgtcaagcggcctgaagaattgaagacgcgctacgctggtcaagttaaactatatgcagcagcgctagcgtcgatgtatccaggaaaggtgactaaacagtatttgtactcactgccacaacaggtgtttgtgccagttaattaagtttggctgtcaggtggtgcttacaaagttggaaaaagcacgtcagaataatctggcgtgctttttgttgagtttggtcttaattaaagcgttcgtgatgtttaaagccaaatgccgcgtggctgacaaatattaggatagtagtaactgataagcattccgttgatcgttgttgtcatgattcatgtagacgataccacggtattcgaagccagctttggtaataatgtgttgcattcgcttgtttaacaagtgcgtatcaattcggagttgacgaaagccgagttggtaactcatggtaatgagattgctaaagtaaaagtcagtcagatgttgtccgtggtaaccattggcaatagcaatacggtgaatcgaggcatagcggtggttctcagtaggcgcccagctgccatcataaataatagcgtaattggggtcaggtgttgttagcagtgcagccgtcccagcaatctgatcatcgacaatgagtacccaggcaattctagcatcaatgtcagcctgaatatcagcagctaacgggtaaccatcttgccattggggaatctgatcggcagccaaggcgtgtttgccctgttcgataatagccatcatggctggtaagtcagcactagtagcttgacgaatatattttgacatgaattatcactactctcgtttagatgctcatattataagccaattttgtaaactggacaaatcaggaacagaatgatacttttttgtcctggtaagctttataatgaaacttaactaaaggacaggagtgacccagatgaaaatctttgtgattggtgcccatgggcagattggtaagaaaatcgtttccaagttagttgcccaaggtgaccaagtgtacgcgggtattcgccaaccagaacaggctgaggctttcgaggatgctggtgcgcagccagtacaattcaatttgatggctcagcctgaagatttagcgttggcttttaatggtatggatgccattgtttttgcagccggatcaggtggtcaaacgggttatgatatgactttaatgattgacttggatggggctgtcaaatcaatggtcgcagccaaaattgccggcgttaaacgctacgtaattattagtgctgaatttacaccggatcggagtcgttggccacgagcattacaaccgtactacgtggcaaagtattatgctgacgaatggttaaaaaacagaacccaattggattacaccattttacaaccaggtacgctgatcaatgatgccggtactggcaaagtaaccgttaaccctgacgttggcggtgagattacgcgtgatgatgtcgcaacttttacagttcaaacgctacacacccctgcaacggtcggtaaaaccattgcgttgatcaatggcgataccccaatctcgaaggctgttcaacaagcttaatctgaggttgagacgggttagcgaccatgataggttactaaaacttgtctgtttaatgacctgcatttggcgacctaacttgacgtacagtcgttataaaatccaccgtgtgagcttatcatattgataaacttacacggtggatttttaggtgctggttagtatgcgtgccaatcgacggattgaaaagcagcggtcagtcgttggatcaggtcggcttgggttggactaaacgtcattgagtggcggtacgcaacgccgacattgaacgtgggcgcttgcgcgtcagttagggggagccgctgtaatcccgccggtaattggacggcgttactcaataaggcaatgcccacatgctgacgaaccatgtttaagatactgccgatttcgttggattcaaagacaatcgttggccgaacatgattttgatgactgagttgacgaaacgcctggcggtggacaaagttatctttgagcgccacaaaatgctgatgacgcaacgatctgaactgaagttgtgagttggttgctagcggatcgtcagttggtacaacaatactaaatgactgggtgtcaaacgtcgtgagttgaatggtcgtatccgtgaattcattgaggtaagcaagtacggctaagtctaattgtccgttttttaatcctttgagcgccgcgagtgaaccttgactgataggttgaatctggctgaataaagcctgtggtaattgacttgcaattcggggaaagtagttgatttcaatgattggcggcatcccgataacaagttgatcggttgtggtgtgggcaacttcttggcacatcagttggtgctctaataggatctgattggcgtgtcgttggacttgaatcccggtcgtggtgagtgctacgggtaagtggggattagcccgaattagtaattgtgttttcagttcggtctccaagcgccgaatagcagccgaaatggtcggttgactaacgtgaaattgggctgcaactaatgaaaaatttttcagctgagttaacgaaacataatattgcaaatctttaatattcatcttaaagtccttatttaattgatgcttaattgttagtattatgatttgttattataacatggttatttgactatggtaatcgttgtggctattgtagggctattaagagagaagggaacgttgtacatgtttacgttcggagagttaatcgttattttagttgttgttgggattgttgcgggtatcgttagcactgcagcggggttagcgtcgctggtttcgtacccggtcctactggcgctgggactgccgcccgttacggctaatgtcactaacaccgtgggtttagtctttactagctttggagccgtgccggcctcacgccgggaactacgggggcatggtcaggaattgaagacgctcatcccgctgactttagttgggagtattgttggggcaattctgttatttattatcccggcagcgacctttgcgaaggtcgtcccattttttattttgattgcgggaattttagtgctgattcctcgtcatattcatattaaacagcccggtgaaattgttgtgacacctaaatggatgacggctttagcttggttgggcatctttttagtcggggcttatacggggtattttggtgctgcgggtggtgtcttgatgttgtcgatcctgtctttcacgagtgccgcaccattcgtcgtctataatgctcagaaaaatctggcgttgggattagccaatattgtttcagccgtcgtttatggcttgcaaacgccaattcagtggcgctatgtactacccttaggcattggttttctgattggtggtagcctaggaccacgaattgtacgccacttacctgccagattacttaaaattgtgattggaatcggggcattgggactggcggccagtttgttcaaatcggcttatggattgtgagtgaaaatgaagttagtggggacaaactcaatagcaatgttaaggctggtaaacttacttacgttactgtcttgaaattaagtcatcgagtctaaatcagcgtttgggctgatactatcaggcaaaactgcaggtcacctgaaatggggagggtttgacccggttggctgatccctgatgatgaaacaaaaaagaggctgtgacataagtctctagaaacaaaacaggtctggaaaaatcttcggatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtgccatgttaaaactggtccttttagcatactgctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgatctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttgaataaacgacgtgataaaatgcgtgaacaccaagcacagcaagcgatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaattggtcacggtagggaccaactttaaaaatcaaaggcgtaagcaaatgggacgagaaaccaaaattcggtttctcgtcccatttgcttatacagaggctagttatgtcacagcctcttttttgattatcccaatgagaactttaatcgtgatggcgtgaacgtgtccctaaaaagtaagcaccaacggctaacagaatcagtaagctgataatgcccaagccgccacccatccacataaagggcataccgccagtaaaagcccaaccgcacatcatggtcaccactttcctaattattttagtttcagtatacgcgcttttgccaggtactaccaaccgttctgcattattttaagctgttgagtagctgactttgttcattggtggttaacggtaaaattggtaggcgcgtgcttccgactaaccagtgttgggcgttcagcgccgctttgacgggtgccggtgagggttgtgtgaatagtgctgccatcttcggcattaaacgtcgttgaatttgccctgcttgggtgatatcgccgtggttcaaggcgcgacgcatcgtcgccatttcatttccaaataaatgactcgccactgaaattgttccctgaccacccaagacgagggtggtcaagctctgagcatcttcgcccgtgtaaacgagaaaatctttaggcgccttttcaacaattgcggccagttcttcatcggaaccacattgtttgatcccaataatgttggggttgtgggccaacgtgagaatcgtcgtgaccgtcatcttaacgcctacgcgaccgggaatattataaattataatgggcaagtctgatttttcggcaatggctgtaaaatgcgccatcatcccggtttggttgggtttgttatagggcgggacaacgacgagggcggcgtcgatgccctcgatttgactgacaatgtgggtgaaatgaattgtggcggcagtgtcattggtccccgtattagcgatgattggaactcgcccagcaacgatcctagctgtctgcgtgtataaatctcgtttttcagcgatgctcaacgtggggccttcgccagtcgtgcccccgactaataagccgtccgtgccagttgcaagtaagtgttcgatcagttgctctaagcggtggaaatcaatgtgttgttggtcatcaaatggggtgaccatagcggtaatcaggtgtgcggatgctaaattcatgtggctaatcctcctgtgtggtagtttgggcgcgccataaggctaaacgatttagcccttcgcgtagtgccgattgactggctgcataacttatccggaaccaaccctcgccactcgtaccaaatgctgagccaggaacgacagcaacttgggcctcgtgtgcgagtcgggtcgcaaagtcccagctggtgccttggaaatcctgtggtagctggacaaagatatagaatgcgcccgtcggatagatataattgaatccaatttcactcagacgtttgacgacgtaatcgcggcgtgtttgatagacgtcacgcatttctgagccatcatccagaccatgggtaagtgcttcgataccagccgcttgggtgattgaactcgttgaagtaacgaggtactggtgggtcttcttcatctcggtaatcaagttacttggggccatgatgaatcccagtcgccaaccagtcatggcatgcgatttggagaggccattgattgtgatcgttttgcttggatatagtgtggcaaaagcagtatggggctgttcataggttagttcactgtaaatctcatcgctaataacgtagattccggcggtagcaatgacggcttgcaaagcccgtaattcatcatcagtgtacgtgacgccggtggggttggtcgggtagtttagaattaaggccttgacgtggtcgcgacggtgatcatctagcgcagcttgtaacgcactgggtgttaatttataacccgttgcggttgtgtcaatgggagctaattgtgcgtttgcgatgtcaacgacgggttgatagctcgtgtaggccggtgttggcaataagacggtatcgccaggattaagtaaagtgagcagggtcgttgccacggcctcactagcgccgactgttgcaatgatttgctcaggtgcataggtgagttggtatttctgttgaaagtagtgactcgcagcatcttgcaaagcggcaaagcccattagtggcgagtagtgtgtccaatcattatgaatagcttgaattgccgctttttttacgtgacttggagtgggtaagtcaggttcgccgaccgttaatctgataatatcgggaatttgactgattgcttcatcgaagcgtcggatgccagagacttgaatttgttggatccgaatatttgtattcatcattaggaccttcctctcaacgtgattaccgtttataataaacaacaatcgtccggttagaaatagacaattttgataaaaatgaaaggacagttgtgtgatgccattaaatcgtcagtcaacgacaccgttatatattcagttataccagcagatgcgtgatgactatgatgctactcaagccaaccaccagttatggtcaattcgtaaaatggcacaaaatttgggggtttccaagaccactgtcgaacaagcttacgatcagttgctagcagagggctatgtttataccgttcccgggagtggctacttttatcgcgatcggacacactggccagcagctaaacaggcgctggagactgtgccacagcccactaaacccagggcgttcacttatgattttcggtatggtgtgactcagttgttatcgccaagttggaacgcttggaaacgggctgtccgactagcgttgcgtcagactgagcagcaaccaacggccgtttatccggatgcgcagggcttaccggctttacgtgaaaacttggttcgatttttgaaaacgactcgtggtgtgcggtgcacagcggaccagattgtcatcacgagtggggctaaggcaggtctcagtattctacttagtatcttgccacgcggaacggtcggaattgagaatccaggctaccgcggtttatccgaattggcggctagttatggacagacggcggtccccatcagagtgacggaagatgggctcgatttgacacaagttcgtgcgcgtaatcctcagatcatttatacgacccctggccatcaatttccattaggagtcgtcttgcccatcgagaaacgattagcgttgttacaatgggcggggactcagcatttcatcattgaggatgattatgatagtgaataccgatacagtgcgcacccattacccgcgctacagtcgctagcaacggctaatcaggtggcttatttggggacattttcgcggggaattgatccgacattacggatgggatatttggtcttaccaccacaactggtggcaacttatcatcaacggtatcaatatcgggctgaaatggtggccggcctgttacaacaagcaatggctaattattttgaagatggggcgtattatcggcaccttagtcgaaaccgagctgctaatcgacaaaagtatcgggtactttgtcaccagttagcgcaaactaagcagatccgaccaattgcaaccggcgcgggggtacacttagttgttcagattccaggcattgcacaggctaaattattagaagccctagaacggcaacaggttcggatttatccgcttaactccaattggcgcgacatgcccacggcggactattacttgttagggtttgccgggctgacactgtcagagttgacgaccggtgtcaaacggttgattcaagtttgtgaacaactggtagggtaggcgtttataagcggaatgggtggtgttagggattattgcgacgctagttaagctaatccgcaggcgcaatcctgaagagcaaaataaacgtgtattgccgatgggcagcaacccatccaattgttaaagcgatataaaaaggaccagttatcaacacgttgttaggcaagtgttggtaactggttcttttaattaagccatttaagtgaatacgctaggacggctagttgcggtagacccagcggtgaccatcttgacgtaataattcatcggccgcatctggtcccattgtaccagggcggtagtttggaaattcgggttgatgttcatcccagtatttttgaatgacgtcaacgaatttccacgaatcggcaacctcttgccagtgggtaaagttggttgcgtcgccatttaaggcatcgtgaagcaaacgttcgtaagcttctgggctaccagccgtggcttcagcatcgtgagaataattcaacttgaccggggtggttgcgaagccttggccgattgctttagcattcatgcggagctcgaagccttcagtcggttcaacgttgattgtcaagatgtttggatcgagactggttgctgcgtcgtcattagctcggacgtcttcatgattgaagatattgacgactggccgtttgaacaccacgtcgattcgcgtgaacttatcggctaagcgtttcccagtccggatgtaaaacggcactccggaccaccgataattatcgatcatgactttaccagcgacgaaagtatcggtgttagaatctgatgaaatcttatcttcgtcacggtaagctttagcatcatcgccggcaccgtattgaccacggacaaagttggttgcgacttcttctggtttaagtggtcgtaagctccgtaaagccttgaccttttccacgtcgatatcattttcagtgaattcaactggttgatccattgttaacagactcaaaatttgcaaaatgtgattttggaccatatcccgcaaggcaccgctgttatcatagtaaacggcccgttcttcgacacccagtttttcacttaacgtaatttggacattgtcgatgtaacggttgttccataatgattcccaaatattattgccaaaacgaatggccgtgatattttgaatcatttccttaccaaggtagtggtcaattcgataaatctgattttcgttaaaagtagccgttaattggtcgttaagttccttggcactttcataatcatgaccaaaaggcttttcgataatgacgcggttaaaaccgttatctgtcagaatattttcggaacgtaagtgttgggcaatcgtaccgaagaagtttggtgccattgctaagtagaagatccggttgccttgtaaaccatattgggcgtccagcttttctgataattttttcaaagttcggtaatgttcagcatcagtaacgtcatgcgattgataataaaaatggctcgcaaattgcgtcaccgtttcctgatcagcattcagatcagctagggagtcactaataacttcatgatagtgatcatcagtccaaggacgccgagccgtcccaataacggcaaagtggtccttgagatagcccttttgatagagcttaaatagtgacgggtacagtttacgctgtgcgaggtcaccagtaccgccaaagatggtgaataaggcaattttttcgttactcatcaatttcacttctttactaagaatattttaaaccaagtacttgttcataagcattaattcagattaaactaccgtattaatattaaaccatacgtggtgatggtcaattataaagtactaatgttgcggagattttgggaactggtgtttcagttcacgctcagttgcaacgttttgcatgatcaaaccaaccgctaaggcgatggcttgaaaattaaagctttgcaatagcggaatcttgaacagaccaccaataatcgcgccgattaacaaaatggaaaagatttcgatgccaaacattgaatagaagcgttgtgcgaaccgccatgtttcctcattttcaatcgcgcgtcgcgacatgtagccagcgagtgagcgcatcttaggcattcgcacgcgttgatagatccagagcaacagaatcactaggaagcctaacgccaagccaaagttgttattcgccatgttgtcacctcaattgttgaaagattacaccggttggcagtgtttaattatattataacaatcatcaggggtggtagtcgacaatcaggttcaaaaaccggacatttcaatattaatttttatggattgtcgaattaatattagtacaacctggttgagacagtttgaacttagtccaaattcatcatggcatcgtgaattataactggttgttaagtgtgctgggaagtttaaagtgattcattaaattaaattggttggtttgttaccaagtgtgccatggttaattgggccgctaaaataaaaatgaacgttcagaagtccttcgaactctgaacgttcatttttacagtgggactagctactaagaatggtgccggaagatatttattgagtagcaggattggttaatccgtcacgtgaatgacgattttacccgtcgtatggcgactttcgatggatcgatgacccttaatgacattggctacggagaacggtaatgtcgcaacggttagcttcacttgaccgctgacaactaattgggctaagtcggctaggtcttgtgatgagccttgggtgaactgaaaggcaacttttttctgttgatcatgttgctgctcgtccgtcggttgaccggcaatggttgcaagctggccgtcagcttttaggaccttgagaccagtatcaatatcaccaacggtgtcaaaaacggcatcatagtcgtgcaagacggcggcaggatcggtttcatggtaatcaatgacttcatcggcccctaggcgagttaacaagtcacggtgattagcactagcggtggtcgcgacgtaagcgccaaaggctttagcaatttgaattgcaaagaggccaacaccaccagctccaccctgcaccagaatcttctgtccggattgcagcttaagattgtgcttcatgccgtaataagcggttagtccagcgattggcaaagcagcagcttgatcaaatgataagcctgctgggagatgggctaattctttagtattaacagtaataaattcaccataagtgccgttattagctgcgtgggcaggcgcggcggaaccaaacacagcgtcaccgatgttaaaaccggtgacggccttgcccattttggtaatgacaccagcgaaatcccaacctaagaccaatggaaaggcccataagtcagtaaaaggtgaggatagggctcccatccggccagcaatatccatgggattgagactaaaggcgtgaatcgcaacttgaacttcatcagcttgtggttcggtcgtgggcatgtcgaccatcgtaaattcatctgcggaaccgtattggttaatagcaattgttttcataatatcgtaaccttctttgattaagtgtgccgttagtataaactatggtgtccacacgatagcaagtaaaaagtaaaaaagttggttaatgatttggagaagcttcaaagtaagcaatcttatgtgctaaaaactgatcagttgcctgtaattgagcgatttgctttttcacagtagcacgatatgagctcagttcttggattcgctgggcccggtttggaatgtggccgtcaccgctgagtagttttagatcaaggcctaattgccgaaaagtggcaacgaattgtagacgctctaaattttgacgtgaatactgtcggtagttgttgtggttgcgtggtacgggcccaatcaactgttgttgttcataataacggagggcgtccttggtcataccggtgatggcgacaacctctttggtactaaatgccgtttgttcggctggaatggtgaaaagtctcatgtcaattgctcctttttgactttagtatacacgtggtcagtgcttctcggaacaatactaaaacggatgaaacggatccgcggagtgggggccgcatttagaatgcaccaaatggtcaaagcacgggcctaggctgcgactacagcgttgcgattgtaaacaacatgcagtgtaagacttgatgctaagcgcggcttaagtaaaaatgatttcgtagactactcagcaccttttgcgacctgattggtaggtaaaaacggtcaggcggcgtatactatttagggtattgttttctcaatgaataaacttaaattagaaatgtggtgaggagatgcaaaaagaagttcggttacggtggctgtttctagccaatttgctgaataatgcgggtgccgcttttatgtggccattaacaacggtctacatgcataattatctcaaacaaagcttgacgttttcgggaattattctttttttgatgtcgttggctatgattgctggtaactttattggcgggcgcttgtttgatcactggcgaccatattatacagcgctacttggtggtggtatttcgaccgcaattttaacaacgttgattttctggcatagtttgtggccttacgcgattggcttgatcattgtcggctttggtgatggtatcagcatgacagtcgtcaatgcctatgccgcaacggtaacgactagatccaaccggtatgtttttaacatgctttatttagcactcaacgttggggtcgttattgggacattattggtcggttacttgttggaactaggtatcaatgtggtgttcatggtggcaacagtttgctaccttggtcttatgacgattacgctaagtacctttaacgtcacaccgactgttcggacagagaaagctgcgccacagaagcgggatgtgacgcctaaaaatcaccgtcaattaatctggatgatttgtttgatgattttcaccatttatctgagttatgccttatgggaaagtattctttccgtgcacatgaccaacttggggattccgttccgccggtatagtgaagtttggacgattaacgggctattaattattgtgagtcagccgatcgtggcgttattcaacgaacgatttaagattggcactcagattggcttgggcattacgctatttgccttatcattcttgggattagtatttgcccggcaatacgttgattttattattatcatggtggttttaacgatcggtgaggtcattggcttaccgattgcacccgcctgggtcgatgatatggcggctgatgatcagcgcggaaaatatcaaggccgatacaacatggctttgtcattgggacgagctgtgggaccattgttcggtggcatgatggtggctcagttctcctactcgttattgtttattacggtgactatcttaatgttaggtagtttggcgttagtcttgtggcgcgcccggcgagaacacttattaaatggttaaggagcaggtgggccccgtgatattaacaaagcttttaaggtcaaatgccttgaaagcttttttgattctttgaaagtgatgatggagacgattgacgatacaatttgagcattatcggatagaataaatgaattaattaataaaatgaggtgagtacgtgaatttgatggtttccagttttattctggtgttggctgcggttgttagtatttttatttcccgggtaatgccgcaaatatctgtgaactacttgagtctgatcgtcggtattggcttgttttttattccagttttgagcaatcatattgaaaacttcaattctgaaatctttattggcctgattgttgcgccactcctgttttttgaaggacaagccactcgactgaatgctgttggtaaggaattaaagcacattatccaaacgacagttggactagtcattcttgccttaattgtcgcgggatttagcttggcagggctgggattagtcggcttgccgttagcttttattctagcggctatcagtacgccgaccgacgccacggcaatggaatcggtgacgaacggtttggagatgccatcaactgagggaacttttttaaaaatggagtcgttgtttaatgatgcttctggcatcatcttattgaacatggcggttctctggtatgctaatggctatattaactatgggcaaacgattattgattttattatttcagctgtgggtggggtactctttggttttgtcagtgcctggatcatggttctgtttcggcaagtattgttacgctcttcgtataattcgttgaatgcgtcgctgttgatgtacgtgattacgccctttattttgtattatgctgctgaggcgattcacgtttctggaatcattacggttgtggttgcgggattagtgcataatgcggaagcccaacgaagccggttaattaatgcacaacaagttcattttgcttttgacttggtgagcatgattactgaaatctttaatagcatggtgtttgtggttcttggattcatgtttatcaaaattcttgttaacgaacaattcgggcatgggtccttgaactttttgttgattgggcttgttctgtatattagcaatgtgctggtgcgttacagctacggtcggttgcggttgagtttcaaaaatcggcccgcatggatttttgcgctaggtggcgtgcacggtgcggtaacgctggccttagcctatacgttaaccgatactgcggtcggacgtggtgactttaacttggttctaatggctgccagtacgttgattattctgagtatggtcgtgccgacgattatttttcgctggttgctaaagccggcgttgactgatgatgaggcaactagtgagattgatcagattcgggtggcgatggttcaccacgcgattgatacggttcagaaaatgtatttgccgtcgaatgtgaaagaatccgtcatttttgatttgatgacccagaaacaacggactaggactcgtgattttgcgcgtgcctgggttgacgttgttcggcgaccggaatttactggtgcagaaaaagaattagagatgcgagcatttatgaatgcactcgaacaagaacggcaatatttggatatgatttcacaacgagaggtcaagtatcagaagtacgtttttaaattgtacaatgaaaccttattagcggaatcactagtcatcggccccacgatatttgataaggataaggcaacggaatagcgtgaaatcgtcgttactgaggcgattggtcaacttcgtgctgtgaacacaatcaaggtccaagttagcgaaaactaacttggaccttgattgtttggttaattcgattaaaaggtttgattgtctaaataggcggccaaacggtctttcatcacgttatagacgcgttcagtatcaacggcagtcccgcgaagctcataatccgcaatcatgtccgtgtcaagttgttcagcataacgccgagcggttagacagtactgatcgttaaagttacggttaccagaaccaacaactccgagacagaaccgtgagttttgatcgtagttaagatattcacctaacacgttggtcatcaattccttaaccccattgtcaatgccgttaccaccgtcaaggtaggttgggacaaaggcgaagtagggttcagtctcaatggcaaagtctgactgttcggtgatttcttttaaggtaattaacgggttgctatcatcagctgcatgctgggtcttggcgtaatcctgcataccagtgacaaatgagcgggtattgccttcaatggagatataaatgatattgattgttgattcactcacagcagttcctcatttctgttttacattagttttagtttacgctgggcactacttaattgcaaacgactacggctccgaatcgtcgcagtttgtcgtgataacggccggcttaagataaacttaatttttagtaggctttcccttaaatcaaccgcatccaatttatgtacaacaggttagtggcaattcacacgacttatcatataaaagtaccaaagttgaccagttgaagttcgccggatacaaaaaaatggcccctaagaaatcaactttcttaagtgccattttaagtagtgcgtgtaaatatttagtcttgtgtttgatcgtcattatgatcgtcaggtgtgctatccctctgggcgctaacctcaaaccaattgatataagcattttcaaaatcaagcgctttgaaattgaagttaccgatttgaatcgtatcaccggcttggattttaggaaaattatccaaaatataaccggtcaaagtgacaacatcggaatcttcaaattcttgtaagtcggtcttgaagtagcgttcaaagtcgtagatggtcatcttaccactgatgcggtaagtgccatcggcctgcttttcgatgtattcgttagaaacattgtcgatttcgtcattgacggttccgaaaagttcttcgtaaatatccttatcagtgacgatcccactggtcccaccatattcatcaaccacgacgacgatcggcgtttgtttgtcgatcatcttttggagaatggcttgaatcggtgtagtttcaggaattgtaatgatattacgcaataacttattgacccgaatatcatcgtcaacttcaccttggcgaattaagtcatagttataaacgtaacccagaatcttgtccttatcattgttagctacgacgggtaagcggctaaagcgtttctgtaaataaacgcgaatggcttgcttgacggtatcgttgatatcaatcacaactagctgagtacggtcgatcatgatatccttagcgatcttgtcattgaactcaaatgcccgctccatgtaaaggtaatcgttacgttcaagctcaccgccagttacggcatttcgtgataggttaagaatttcggcttgtgaataaacatcattatcttcattcgcaactgggatgcctaacattttgacgacgccagctgatgagacattcaacaaccatacaaaggggtagaacatcacgtggaaccaccgtaatggtgtcgtaatgactgccattactttgagtggcatgtcgattgcgatatttttaggcacgatttcggttaagaccacttctaagtaggtcagtaggaaaaccccaatgacgatactaatacctcgtaataccgcggttgagacggataggttgaagagggataagaaatcaagcacaaagtgttcagttgtttgttcaccaatccaacctaaaatgataccagctaacgagacccccacttgggtggttgaaagatactcgttaaggttgcggaccatgtgcaaagaagttgcgatccgttttgacggtttatcacgttttttttgttcttcttcgagagcgctagggcgggtctgaacgagtgcaaattcacaggccacaaagaaagccgcgacgaagaacgtaatgacaataatgactaaatttaaaattatctggccactgtccaaagaaacattcctcatttcataatattagttactttaagtataacgcgaagtagctaatattataaggcttatcacccgttttgtcagcccccgcgacggttaattaattggtctatcgtagtcagcgggcctactggcaaccctttaagccccaataatgcgattgcgagaaagatggttaacgtttccaatgaatggtgctaaactaagggtataccaagtaaagggagatctttaatgatgccagtagaaacgaaaactaagattcatgaggattcgaagaaattggtttatcaagatagtgatgtcaaaaaagcgatggatttaattcgtgaccgtggttacgtgacccgtgcagatttcaatcagatggacgatgcggattgggcggccggttttgatcaaaagattgaagccgctttcctaaaagttgaaggcgaagacccgtacatctacttcgaacaatttgatttcaagggtggcgacattgattcgatcatctttgatatggaccaagttggcacgcgtgaccatgccttagatttacttgctgaagccattcaccaacaggcttactaataattgatttgatacggaggttattgacatgcgccagcaattattcggtcatcatctggatgatctactaaagcccaccaaattattgaagcgggctcaccgggaagcagagaacgtcttaaacgcacacgttgggatgaaaacggacgtggttgaacatgacgatgattacaccgtaacggcagaattacccggttttgataaggacgctattacggtgaagtatgctgacgaatggctgactattcgggcgcaccggtcgcaagacgatcgtaacgatgacgggcgcgtactccatcgcgaacggatggacgcggactttacccggaagtttcatctaacgaatgtcgtgcgcgaagagattcaagcgcattatcaagcaggactgctgaccgtgacgttgccaaaaaccgttgcggatagcgaaggtaagatagaaatacaataaataaaagcatcgtcagcgaatcctgacggtgcttttattcgatacatacacattgatggcaacggatttttttgcacacttaggggtgctgttagcaaggtgctgtctcaactagttgacagagctagcaatcagtcgtgacaacctagtgagcacgaatctgaaagtctgtagcataaccaggtaccaattcagcgcggggtagtcagtgaacatcggtcaccacctgagcagcttattagcaatcatgatgtgatttaaagtgcgagcctacttttgctcatcagtcgcatcgtcattggtgtcttcagctttattagcgtccgagatgctcatttgaatcgtacggggacggtctttgataataacaatcgtcccatggccgaggaagtctttgggcccatcataggccatttcatattcattggcgaatgagccggatttttgaagtgtcatgaagaaaattttattgtcttcgtagtcgtcactgaacatgatggccatcgtgctatcaatcaataatttctctttgcgcatcgctttgagacggtcccaaagtccggcaatcactgcttgtggaatcaattctttaacatcatcaccgacacggagctttttggtcatttcatacatactacataacctacttttcatttgtatttgcattaacccataaatgataccatattcagaaattaatgtgatttacaatgtcatctagtttacaagactagttaatctaggtataattaatgtaacctatttatcagaggaggacgcagcatggcagctaatgagacttatgcagattggcaagcccgcatggcaaaggtgattctgccgaagtggatcgagttaccgaactttgacttatatatggatcaggtcctattattaattaatgaaacgttgcagccattaggtgctgatccagttactgccgcaatgatcaataattatgtcaaacataaagtgatcttgtcaccagtcaagaagaaatatcaaattatgcaattggcggatattattgtcattagcttactaaaaccgagttatccactggataaaattcgtcagggaattgaccaagtgactgcgactggctatcccaagcgagcttacgacaattttattacggtattaacgaatcaacttcatcatcccgatgatccaattacgatttctgatcaggatctcagtcacagtttaacaaccgcagcggctcaactgattgttaataaattgcgcacggatgaattattgcgacttaatcaagtacagaccaagccacaacaaattgaaaaataagctgaatgcggtggaccaagtaatgtcagttatttggtccatacgtgtttttttggttgctggaatggcggggctttagtatcatataaaatgattgtaagcaatttaaattgggatagagtggatcaacagtggtttgtttgttaatctgctttacattgggaagagtgattgatatgaaggtgtttatcagtgacgatcaagaacaacagcgtctctggttaaacgacatcattacggcacagctggaggcattgcactttaattatgagttagtctcagtatggcagccgaccgatgtgttagcggcggtaaaggatggcggcggaccaaatctttattttttagatatcgttttacaacgcgaaatcaatggcattcaattggcctctaagattcgtgattatgatcctgatgggtttattgtctatgtgacggtgcgtgatgacatgatcccggatacgttgagtgcgatgacaacaccaaccgggtttatttcaaaaacaaatatgttcgataaggcaaagtttgttccagaagtacaaagagtcctacaagtcgtaaaaaaacggttaggtatgttacagcaatctgctgaaccgactttaacgattcgaagtggtgcgttattattaacgctgaagcttaaagatatcatctactgtgagaaggaacatgggctgcggaccacgcgaatcgtgacgacgacccagtcctatgtcgtacataagaatttaaatacgattaaggaacaactgacagcgatgcatttttttaatgagtttcaaagttatgccctcaaccttgaccatgtgattacggttgattttaataagggcgtgattagtatggacaatcatgatcacttgacctttagccggggaacgatcaagaagttacgggcgtactaccagacccagggataggatgagtgtatgataactgaaacacaattaacggcaattcaaacgtatgctttgcaaaagcttgctcacgatcatagtgggcatggtcgcgatcatttgcagcgggtcaaccggctagcacgccggctggcaaaagccgaaggggcgaatttaaatctgactttagcggcagcttggcttcatgatgtgatcgacgataaattgatggccgacccagcgaaggcgcatcaagatttgattgatcaattgaacgcgcaaaatgttacggctgccgatcaaacggctatttttgcaattattgatcacatgtcattcagcaaatccttcaacggtcctcaaaaattaagtcttgaagggcaagtcgttcaggatgcggatcggttagacgcgattggcgctatcgggatcgcccgggcgttgtattattcaggtcatgtcggtgaaaaaatctatgacccggcaattgcgccacgtgaacatatgacgcgtgaacaatatcgacaccagcccggcacggctatcaatcacttctatgaaaagttgttcaagttagcagctctcatgaatacggatactgccaaagcactggcagcccaccggacagcggtgatgcacgagtttgttgaccaatttaaggctgagtggacggcggatgataaggcgtaatggcatccctacgtctagttgaatcactagttctttgagctgagatcatgttatcagatgatgcaattaccatttatattggctaacgaaaaaggccatcacaagaatgtatcgtgaattcttgtgatggcctttttagcccttattctggttttaaggctggcaatctaaatcaggcacggttggtcaaaagatgggttaccaacatgactagtagggacacgagtagtgagtagcccaagataatggcgaccattagtccccaagtaactaacgtatggatccaaccggtgataccgatgaacgtcagtaaggtagtcagcacgataatgatgacgatggtgctatacaacccgatcgcactattctgataatcagcgggacttagatcgaagccaccaatcacaatgacgagggttagaaagagcaacattaatagttgccaccaactcgttggcgtactggttaacgcgtgaaaacttgcagcccattgtggttgttcgggtgtatcagctaatttgaagatggcttgaaataggccaggagcgagtagccagtctagtccaaggagtgccgctgtgcatccgaagatgggggcgacaccaatgaacaggttaccaatgacttgataccggctgtgccgattccaagtatggttaacatagcctagtgccagatcatccgccgactcatcttcaggatggaggtgagggcgtttgagcagccggaccgattggatgccgtggcgaaaaatcagtgcgaggattagatggctaagctcgtggatgatgatgcccagaaaaccacagtagacttgactgttaataccgtagtggttgaccagattcgctttggtttgtcggttgataatcgtcagtaaccaagcgaatagtccgggtaaaccaatgatgaccagcaagacgatgccgttattcttgatcaagttatccacgaggctactccgttattggaccaaaagtgccgtgcacgagcttgcgtagatcatcagcgtcgatttcaattgaacgcccgattttacccgaagatacgagaatcttaccttgctgcttagcggtctcgtctaagtagatgggaaacttcttagtttcccaaataccaactggtgtgttggcgccgtgttggtatccggtagttcgttccaagtcctttaatggaatcatgccaacttttttgttgccggatagcttagccaattttttatagctgaggtgctcatctaacggcaagacaccgacgacgggaccagtcttgttaccaatcagcgctaaggtcttgtagatatgatgttcgtcaacaccgaggtggtcgacttgtaattgttgaacgtcgccttccgcttcggttggaaattcatattgttgatagctgatatttgctttatccaaaatcttttcaacaagtgttttacctaattgatcttttttcttcttttttgacattattgttaacctcacatttattaaaaatacggtccaattttataaatggaccggaacaattcacccaaacgccattaattctgctatacttgaggtatgaaataacctcaaaggagggattacaatggctgacctagtttatcaacaagtcatcaatgatctcaataaacggatcatggcgaatgaatttgttgataagaagcttccagatgaacgtagtcttagcgaacaatatcaggtaagtcgtagctcgattaagcgcgcgcttaacgtgctagccaataagggcctgattttcaagaagcggggttcgggaacgttcattaatccattatatcttaaaaatcaatcttcgtttaagtatgaaggaactaacctaggaattacggacagtttaaatactgagggtgctaagcccagtattcaattattagactttcgcgtcattcctgcaagtcaagagttgcaacaagacttatttttaactgctgacgagtttgtttatgaaatcaaacggctgcgattactggatgaccagcctttcatgattgaaagtggctatattccaatcaagcttgtgccccagttgaaccggcaagtggtcagtggctcgatctttaattacgtgcaaaagaccttgcacgccgcagtgaccaaatcattcttatcgattgcggccgatgcgtccaatacgactgatcaagagttgttacatttgcagccaaatgaaccggtgggcctgatgagtgggattttcttcttagatgatgggacaccctttgaagtgtctaatatgcgactacattatcaatatatgaagtatacaacgtttgtgtcaacgaatagttaggagtctgaggtgtcatggcactgattcgtattaattttatggcggctagtttacaccggaccgttcccctgatggtgtgtttaccaacggataaattggtcccagatgagcagggcgtgccgcgcccgattcagggtccgtttgccaccctgtacttattgcacggtatcttaggtagtgaagtcgactggattagtggcacacgaatccagcgctgggccgacgaacggaacctggctgtcgtgatgccagcgggcgagaatagtttctatactgatcatccttggtctggggagacgtatagtcgatttattggtcaggaattgattgattttacacgccggacgtttccactatcataccagcgtgaccaaacttttattggcggattatcaatgggtggttacggggcgctgtataacggactaaaatttcacgatacttttggggccattgtgagtttatcagccggactgaatgtgcgacccggaatggaaaagttaccggcaaaacctcagtggtttgcggaaacggccgcatatcagcatggcgtttttggcccagatctagcagctgctggtcattcggaattaaacccgcaagtgctcgtaactaaattactggcagctcacgtcgctttacccgcgatttttatggcgattggcgatcaggacggcttaaagtcagcgaatgatgaatttgatcattttctaacgaccaaaaaagtttcgcatgaatatttggtcggttctggagcgcatgagtgggatttctgggaccgctatctattaaaagcactgaactggttgccactaactaatcagggcgccggtgttaattctgggcatattaaagctaattgatgggctgcttcaatcattctgtgtacaaattattaaaaaatatattaatctaaaagcaaggtgtcccaagggatgagccttgtttttttgttttaatttataaaattggaccgttccaattaacaaaaaggttgattttttgaaatgagttgttaaaatagaacttgtaaacgaaaacatttaaacagttagcgttcaagtgaaaagcaaattaaggagtgtttttgaaatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaacccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacaccggtgcggccttcgttcaatccatggataatatgcttgctaaacacaatgcctatatccgggatgccggaactgacttgccagaagttaatgattggcaatggaagggtttaaaataagcagttaaaatcttaatttgaaaatagcgttgctactggcctgtgcctccagtagcaacgctatttttgtgcgctattaattgtgttgattggtgctggaatgtagcctatgacgtcttaatcagaacctagctaactgacgtttaatcaagaagcaacttgcaatgactagcataatgtgaattgtgagcatattttaattggtttttaattattcctgttataataacgctacctaagctgatactagtgatggtgattagttaaggatgaacgggtctgacgcaatcagctcagcctaacatcgtcgattccggttccatgaaccgagtttatgtggaaaggagcgactggttgtttaatcgccagtcaacgatgctaatgaaaattttgataacagtcgagaatttagtgatggatggtgtcaaacgagcggcgacggtcctcggcaatgcgttgacctcgcaagccgaggttgctttttactccttggcccaaccccggtctttctatgaactgagcgcaccgcttatcacggcgcgccggcctgcaagtgcgacggtacttaattactttggcgctgatccgttgaccgtttatgcgcctcaaatagatgatttactcacgacgattgggtcgggagcttacgatgccgttattctcccgggaggtttactgacgagttttgctccggcaatcaaacagcgttttccacgggtcaatgtcattgcgtggatgcacaataatgttgatatctacctcaatcagtattacgtccaaatgcaagatgaactggtcgcagggctcttagcggctgatacggtcgtgacattgaccgattatgattgggaaggctactcacgttttaacgcccatacggtcaagttctataatccaccgaccatgcaagctcatggtcagcaggccgacttggcgcaacatatcattgcctacactggtcgtattgacctgcaacataaggggctcgattatttgttgacagttgcgcgagccttgcccgatgattggcaaattgcagtcgcagggactggtcccgaagaccaattagcgacgttcaatcggttgatggctgaactcgatgttcgtgaccgcattatttatcggggtgcgctgaaagatactgagttacgggcgcattatcaacaggcgagtgtcttcatgatgacttcgcgttgggaagggatgccattagttatgggggaagcgatgacgatggggttaccgatcgtctcaatgtggaatactggctcagccgagtacttgcagggtggccagtacggtgtgttgactccggcccgcgatgttaatgctctgattactggcttaatgccactgttaactgattttgactgtcgcgctgaatatgccgcgcgcgctcggcaacgcagtcatgactttaccttgagcaagattgtccggcagtggctggcactattgaatcgccaatatgttccgcaaacggtcgtcgaatcaaattggcctgcggatttgagtagtgggggacattagcctgtcatagcggtcatgataatcgctcagtacctaggacctgaatggttggtgctgagcttttttgtcattgatggtggggattttcttttgatagaactattatataaaagttatgaattctattaatcaatttgcaaacgcgtgacgactttgatacactcaatcaaaaggtcagccctgcctgaccgcattggaggagcttgctattgaagacaacgtggctggctagtttactagtcacaatcttttggggcgccgtattggggctcgttgtaacgtatttaggtggggcgatggtcgaggctttgaccgccacccccatcgttcgtgaaccactcaaagccatggcggtgggtatcatattggcagtgatgagtgggttattagtgacaacgcaccattaagaactgtatgctggctttaagggcgcttagccgaccgttaacaagcttgataaattaaaaatgattcgccttcttgtcagaggaaggtgaatcattttttagtgtagatgaatcacggggttcaatggtgaactaactgtccggagtgcgttgcgcaaatgctcacgatttggatagtcggagtagtttgagtaacgtaccggcaagttcttcacgttgatgggctggcagatcactcaggtagtcgagtaatgcaacaacattaggtgattggagaagctcgtcgcgaaagaagtccgctatttttaaattcagagtttcagcgattgcggtcaaactttgtagtttaatgttatcgaccttaccacgttcgagtcgagaaattagcgagattgaaacattcgattgttcggccaattgctcgatggtgatgccgtgttgctgtcggcgttgccgaatgattttgcctatctcggttaacatgggaatcctccttaatccattaagcgtcttagcactaattttagaggtttcgctatgcttgaaacagagctgtaagtaccttataagtaccgttataaggtcattaaagcttttgatacgtgatgctgattaaatcacgttactttgctttcagttatcgaactcatgctgaatttgtgatccgttgaatgtgacaaagcaattattaggttacggttaatgataaaatagtaacatactataaatgtctttaaatacttcttttagtcgtatataatgttattaaagctttgttataacgctattaaataattagtatagcttgcaaagcagaatagaaatcagagtgttgggaggagcttatttcatcggatgtcaaattaatggaggagtgtaccaaaaatgaaaatatgtccaaattgtcagcatgaaaatgaggctgataatgttttttgcgaaaattgcggagcggatctgactcatattgacagtgctgaacgaacgcaagccagtggaacggagcagaaactcggggattcaaggcaatatcaagctcataaaccagctaagacgcagcaatcaaggtggttgcgaatcagtggaagcgtgctcgcagtcgtcattattgtgggaggtggatttgggttttatcaatatcacactggtaaaaatcagcagattgccgcggaagtcgaaatgatgactagtaataagcccacgacattgtcgaaacacttagttagcgataatactggattaaaaatcacaaaacagtccgtaaagcccttaatgacctatatccaaaaacatccccagtacgcacaagatctgaaaacagacttacagcataacggttattctagtgatcacacgtttgttgttaagcaaatcggaactaagtggacactattcccaacttacaaattacgcgtcaccacgatgcagccgttaatcacgaccaatctaaaaaatgccacactggaagcaaatgacatcgaattggtgaccaccgaaagtgcgcatgccacttataaggttggtccgctgtttccggggacctatatgtttaaactaagtaattctgacacgacaatcacgcacaaggttaatctgatggggcacgcgaacgtccatgaattaatttcgttagttgcgaataaaaaggcagcgacaacgtcaacggcgaatactgacaccaaagctaccactgccagtgatgaatcagactcgagtttaatcaacagcgagagtgaatcgcagagtggtacgggcagtgcttatgatgatttgtctagttcagctcagacagctgtgtcagaaattgccgcggctaccggtggggatattagtgattatgattatacggcgagtgaaccacacacggatgtgtatgaaattaaatgctatgttagtggtactaatgatttagcagatacttatcgatatgatgatgttaatgatattctagcgcgctacaacacgagtaccggtaagtttgaaacggtagattcaaatgattaacgagaaatttatgattaatttggaggatgtttaaatgaataagcaggcacttttttgctcgcagtgtggcaatcaactgaaagccggggcgaagttttgcccgaaatgtggtgctgtggttgccccaaaccaggaaattccggatcaagggcagtcagttgccgaatccgagaatacggttgaacgtagtagtgatgataccgtcaataaaattttgaccacagataccgtccaacatgtcaaaaagttctctggaagctacttttcgtggtttaagatgacgatccggcatcccggtcatccgattgaaccgactaatcggtactttggactaacttcgatcggtcttgaggcctttttactggttttatcaattgcgttaatcttacgtaaggcacaaaatgtcgccaatgattttactagttcattgactggtggtagttcggaagctgcgattcatgctggcagctttatcctaaaaacgagtatgctggtgtttttcatggttcttgggatatatgcgatttatgttagcattgcctatgcctttcgccgcgttgttaatactggttcgatgcaatttagtgattttatcaatcaatttgcagcaattacgaatttgattctaatctttaatctactcacgttgcttttgacgattctcactggaactggtaatttttctggcatgactggattgttcttctttatgatcccaaccatcgggattatgaatctggcatttatttatatcattattgataatgttgtgaagccccatattgacaaattttatgcgttaatcattgctgaaatcgcattaggttttgcactatctgtttatgtcatgatattagccgttttaggtggcaatatgcttttctcacaactatcgtcactattttcgtaagcgttagtaccgtcggattaccgccgtgacggattagttaatttttaaagagacgatgccatggattcagagcggaaaaaaaggggaccagattttgaaaaaaagtgaaactgtctgtatcagtctgctgttactgttatttattagcggttgtggtagctcacagcaggcctcgcaagcgtcacatgcggataagaagcatggcgttagtgtggtcaaagtgaagcccaaagtgattactgataaggcgcacaaaacaaatgatgcaactaaggcaacgagtacgtcagtcaacgcaagttctcagtcgacaaaaacaacgtctcaacaacggggggctacgactatgaatcttaatgagatcagtcagggctcctatgggagtttgttaggtgactggaaggaagttgctagtagtgtcaataagcatgatactaagggcgatgtttggcaatctcccgaggctggcgctaaattaaccgtaaaagacacgaaaatcagtgacggtgaaatagccttaccaagtgggaaatttgaagatgcgaatggtgatgaagaggctgttactactaccatcaaacaggaaaaaggcgcactgcatattgatggtgatatcggtgcagctgccgtcacgtactggttttatccaaagggagttgcaatcagtggctggggtgataacgttcctgccaccattaagacggatactgagcgaatcataacgcgcacaagtaataattcttatgtaaaagtttttgaacgtcaaacgaccgccgccaatacgggaaaccgcaagtcgacaatggcgctcggccagattaaaactggtgattattcaagtttgaatgggacttggcaaaatggacaaggaaatcaaatcaagattcataatcagcggatgaaatttagcgattttggcctgacgcaagacgctactccggggacgattactaaactcaaaatggatgtgccatcattagatgatcagcaaggaaattctaagacggttgatggattgaagtatcatcaacaattaacttatcaaacctcaaatggtgccagcatgcttcaaggcagtttttcaatatcaggctcatctggcggactttatgatgtggtatttatgcccggtggaaataatgctgacctaaataatggtgatagtagtcgggaccgtatcgtagcgttaggaacgcaaaatgatccccaaaacattccaagtgataagatttattatcgctcaaattaacagtttagaggcataattaagctctttttggctaagataaatatgcaggtgtcaaaaaaaggaagctcactgagcttcctttttggacccttcaagatagatactttcacaacagtttgatggcaagcgccggtagccatctgaatgaagttgaacttgcttagtcagtagcgctcgattaaatgcggactattaaataaacttggcaatggggccggtaccgtcacccgtgtggtgctaaatggaagttgtagatccaacaattgggcatgtaacatcagccgaggcgccgactccgcttgcgagtcgtaaagtggatcaccgataatcgggtggtcactggcggccaagtggacccgtagctgatgggtacggccagtatgcagggtcagtttaactaaactctgatgggcggttgttgcacatacttcgtagtcggtgagtgctggctgggcatcggccgtgttgacccagcgtttgcgtttgtcggtagcatcgtgaccgattggcgcggtgaaatgcccagttggcgtggtaaagtgaccacgtacccaggcataataagtccggcgaatttgcttgtcactgattaagcggtctaaaatcgggacgacgaccgggttcaatgcgactagcatcgcaccagaagtcatctgatcgagccggtgaaccatgtatggtacctgctgagttggttggagtgtggctgctaggtcatttaaaattgatccggtttcacctggttgattaggatgcgatttcacgccagcgggtttatcaacgactaacagatcgctgttttgatataaaatcgtggctggggccgtggcagccgcaatatagtttgaggtcggagtccgaaagtcactggggataaacgtcagcgtcaggcaatcaccagtattgacgagttgtgcaatcgacgttggtgcaccgttcagctgaatccgccgcgtttggcgtaactggccctgaatccgcttaggaatcagccaggtccgaaggcaagcccgaatcgactgttgattcaagctagacgggatagtgagttgataagtccaggtcatgaataaagctcctttataacggggaagacggggcaacgcacggaaaccactaaaaaagtctggaacgtatccagacttttttgttagtcttcttttttagcggtcggcttaacgatcaaaacgtcacaaattgcgttgcgactgacgtaggtggttacggaaccgaccatcaaacgttcaacggcagataagccggttgaaccaatcataattaattcattatggtggtcagcgggaaattcacgcgcgataaccgttttgggattaccaaaacgaacatggacatcaacgtcggtcaccccagcgtcaattgtttgttgcttgagttcttccaagcgcttttgaacgtcttccgacaacttgtagatgacatcaccactgaccgcaccgccgtacgtgtcactaaattggttgacttccaacacgtttaaaatgtcgagatgggtcttgttacgcttagcgacttcgatgccccgccgaagaacttcgtcggtagccttggagccatcaactggtaccaggatattttgatattgttgtaacataatggttacccccgtttgatatggctagttaataactatattttagcattaattttcagcaatgtaagcatttaaaatcgattgatttatttgataacttgagtttgtaaggataattattttaatggactgaaaaatgactaatttttttcagtcggtactagtcattgaaaaataatattcttcaaggtcgttaatcgatcaatcagtcacatttaatttaaatacagtaattgagaagcaaggtgattttggaaaagcccctggtcataacgtcttgcagcgattgtcaattcggtcaacgataacaaattgttaactgatcaatcagttaaaatgataacggtgtcaatcaattgatattaataaaataattcgaagcgatctcgtttgaatgtccctcttcgacatgctaatattattctgtaatagcaggtgctacaggggaattaaatcggttgtgctaacagctaactcacggaaagtttggggattttaaaattgaaaattggaatgacaaaaaaagtagtaacttcattattgctaagtaccgctttgctgccgatgttgagtggtaaagctgatacggcaagtgcaaatcaaaaaccggcagctgcgactaagggaaacagcgctgcttcagctgcaagccaacaagtgaccttaagttctggcagtcagacggaaacgacagcggccggtgcgactgaccaatcagttgccagtgacggtgccaagactgacgatcaagctgaatcgaccagcacgacgacggctactaccagtgcgacaagtcgtgtcacagtgcgggcagccagtcaagccgctaaagctgacagtacaggaccgcaaagccagtcctccgccagtgaagctgccaaggataacgcggctgctagtgctacggcggactccacaactagtgctgttgatcaacttgataaaacggccaaagctagtgcagccacgagccaagccagtcacagtacgactaatgagacggctaaagccagcgcggccgcaagtcaggatagtcatgtcactacggaccaatccagcgcgactgtgacgagtgaagtagccaaatcagccgcatcgtcagccgcacctaagcaagcgactgagcaggcggtagccgcgaaaatctcaccaaagattgagacggctgtggcggctgatgcggtccagtcatcagcgatgatggcacggtccacgcgggcaatgactagtcaggaaatcttcctgagtcagattaaagcgggggcaatctctggttggaacaagtatcaagtcttgccatcagtcacggccgcacaggcaattctggaaagtggttggggacaatcacaacttgcaactcagggaaacaacttattcggtatcaagggaagttatcaagggcaatcaatctacttcccaacccaggaatggaatggctcacaatacattacgattcaagacgcttttcggaagtacccgaattggtcagctagtgttgaagatcatggcgcctttttggttgtcaatccgcgttacagcaatttaattggggttaccgattatcggcgcgttgccagtctcttgcaacaagacggctacgcaaccgcgccaacgtacgcgagttcgctgatcagcatcattgaatataacaagctacacgagtgggatcaagaagcgctcagtggtcaggcaagtggcggaaatgataataaccaagttcagcctgatcaagacgtcaccccaaccagtggtacacataagtttactaagacaacgacaattcacaatgcgccggacgccacgagtgccgtagtgggtacttacaacgctggtgaaacagtcaattacaatggtaagttaacggtcggtaatgcaacttggttacgctatcagtcctattctggcgtatcacggtatgtgatgattagtcaaacaacaactaatgataataataaccaggcgacagttacgccagctagtgggtcgtataagtttaccgcaaagaccaacattcgatcagctgcaagcaaaacggctcaagtggtcggcacttataatgctggtgagacggtttactataatggcaagattaccacgggtgggacaacttggttacggtatttatcctattcaggcgctcagcattacgtggctatgagtggtgatgaggttggttctgtggctaaaccggacgtggttgcaaccagtgggtcgtatcgtttcacgaaaacgacagcaatcaagagttcacctgcaactagtgcgacaacggttgggtcttataatgctggcgatacggtctattacaatggtaaggtgacgacaaatggtcagacttgggtacgttacatgtcttactcaggtgcccagcattatgtgcaaattagtggtgagagtacgtcgaccaatgttgataaaccgcaagtaacgcctcaaagtggtagttatcgctttacgcaaacaacggcgattaagaatacaccggccggaaatgccccaagtgtcggtacctatagtgctggtgatacagtctactacaacgctaaggtaacggctaacggccagacttggttacggtatttgtcttattcgggcgcccaacattacgtagcgattagtggtaatgccgctaccggaaatacgacgtctgagccggtaacaaacagtcaaggggcgttccgcttcgtaacgacgactaatattcgtacggcgccaagtacgcgcgcaagcgttgtcggtgaatataacccaggtgaaacggtttattacaatgggacggttcaagctgagggttacacgtggctccgatatctgagtcgctccggtgcaacgcactatgttgctaagcttgaaggctaggcatattagttgttccggcgtccaaatggctttatactaaggatattgaaatggaatagcgattacgaccgctattaatgtttcggcaacctagttggcttcggctgactaggttgttttttttactcggtttgcaatcgcttacattgtatgctatattggatttatcggaagagtcacaggtcagtatcaaactgttacccaattgttgtaacaaacccgtcaagtgatagctagtgcagtatagcagcgtttccgctaatttcggataactgactggcccaacctccatctattgatggcacggttatgtccacggagaacggattgccgccaatcaaacgttcacggatgtggatagtgaatcagtcatcttgtggtgtgaagaatgccacgccaaactttttgtatgattcttccaaaaaatgggctcacattgtgggtccttttttcatcttgctgtatgattaaagtaacctaaagctgaaggagattttaaaacatgtattatgtcgcaatgaaagatcatgagattggccgtaacttggcaaccgaacaatatttaatgaataacgtggatttcgatgaaccattagttttgttctactatgaagaaccatgcatcattgttggtcggaaccagaacacccttgaagaaattaatgccgactatgtccgggaacatcacattaccgtaacgcggcgtctctctggtggtggggctgtgtatcaagatcttggtaacctctgcttcagctttgtggtggatagtgacagtcaagagtttggcgactttaagacatttaccaagccaatcattgatgcgcttcacgatatgggggcgacgacagcgacggtcagtggtcgcaatgatttgctcgttgatggtaagaaattctccggtaacgccatgtattcacggaatggcaagacgttctcccatggcactttgatgttgaatgttgatttaaacgttgtcccacaggcgctaacagtcccgaccgacaagattgcttccaaaggtattaagtccgttcggagtcgggtcacgaatttacggccttatttagcgccagaatatcagaatatcacggtgccagaatttcaggatgccctgttaaaagagttgttccatgttgattcgttggatcagattgcggataaggaatatcacgtgacacctgaacaacaaaaagctattgataaaatttacgaagactattatgctaattgggattgggtttacggtaaatcaccggaattctcggttaagcggcgtcaacactttgatatgggaaccattgatgcgcggatctcggttgatgacggcttgatcaataacattaaattttatggtgatttctttggtagtggcaacgttcaagatattgaagccgcccttaaaggtgtgcggtacgaccatgaggccatcgctaaagcgctggcagatattgatttaaatcagtacttcacgggaattgaacggtcagccgttattgacttaattgcccaataataggagtgatttgttgaaactgactcgcttagttgcatttgcgtttgtgtcctttttttgttacggtatcgtcaattggatgatgtcgactagccattttcacctgcaggcaaaaaatatttcggtagcggaaatgtggcaggggttgctgattgccctagtcttatattttctaggcgttctagcagtgtatattaatcgtatgctgggtttttacgtcctagggttagttgtactgatatatagcttaggacttgtcagcgccttaatgtcgggctatcagagtacggctggcatggaaattaaactggcgttagaagttatgggtgtgattggattggggatcaacttttatacgttggtgttactgactcgctggcgacgtgcaaattaacgaaattgaataatgaatgagggataatgttttatgcaacgaaacgtacaagcttttattgatgatgttacggctgacaaggttacgcaggatagcttgactggtacctatgccaaactagcgaccaaggttaagccttggctggcgaagctggtagcggcactcaatgccgaccagcttgcccaagtgacgctgacggctaagcatgagccagctatcagctttcggttggagacgagtgttattaatttgccactggctaatctgaccgaaattggaaaggttacggcggcagaggatacgctgccaatcaacgtttacatgattgcagaatccgatgcgttaccgtcaggattgcgaattgatgagctgggaagcgttgccgacgtgctcgctgatcaagccaacgctgaaaagttattaaccgattggctgacggctcagactgatcgcttagaccagattacggcggcggaagcttaaacgtaatctttacgagttaattactaaatctttacatgactatggtaaggtaagaattgatattggagccaagccaaaatcaaaataccaatggaattgagtgtgtcgttcattaaatcgaacgggatactcaatttttttggttgcgaaaagttaagtactgcggcccaactgtggtgagtaggagccacgaattttgtggcggtgcgacttgcattttatcaatgaagatgatatggtagtccatgcgatgagtcgatagagtcagatcgttagcaataacggttccgcgcgagcggctagtgactaatattgatagcggggcacgtttctctgacgtatttcagagtgtctgggtcactgacattgtggagtgtcactcccgctggttttaccagtgccgcgatgaacgcgtgttaaccattttcggatggctgacacgcgttttttttgcgtacagatcacgcataagactttcatagggtggactattcggcaaaagcggtggtcgactggatagtcgtaaaataaaacggacggccatcaggataagattatcccggcgaccgtccgtcaatggactgaaagattagtcctcttcgttcattgcagctgctgactcggtgttagcagttgcccgttgcatttttccaagcacaccgcgggcgattgggccgacgatgatgagttggagtggtaatgcaacaatcaagttaaagatccaagtgtgaccgtaagtcgctaaaacgtgacttccggacaattcaccttccactgcaatcccgaagagggacatgcaagttaccatgccaagaaccatcaagacggagatggtaatcccaatcaagacaacccgtttgcgcatgtaatcattaatgatatatttgaaagctaatcgtttggcaattggtcccacgaccaataagtctaaaatgatggcaacgaataaaccgagtgggtagccactaaggattgccattactaacccattgctgaaaccttgagcaagggtaacgttataggcggtcatcacaaagaccattaaaccggccataatggcggtaaagacaacttcttcttttaaattacgtggcattctattcacacactcctagtttttttgtatcggttgattactatagcatgcgaagggggcctcacataagtaacaatttgatgacaaattatgaaacggttacattgttagcctgttttgggccgtagtcgggtgtcatttacgatatacttataaggggcagtatgatggcaaaatgaactttaaagaaataaggttgtggaaacagctttcaagttaacaaaattcatttctgctgatgccacggttgttgttgaggagatacgtagtcaagaaaaggatggcacaatgaatcttaggtgcccaaaaatggaccaactgagccaaatataatttaaagttaaatttcgatccagaacaggtaaacgttggtaaagtgagacaacatagcgtatgctgtagttagcatcagacaattaatctttggggagttgattatcttgaaaaaaatgttagttagttcagccgtgattgctgggatcattgcgctgggaggcggttattacttagaagccgaccatcagtctagtcagtcgcgggttagtgaaacacaatcagttgtgtcaaagactaaggctaaaaaagacgcgtcatcttcagcaaagtcgacgaagcaatcgacagctgctaaatcgtcgtcaactaaagcatcgtcagtttccacaacttcagctaatgagtcacaatccgaagctagtgcaacgactagtcagggtagtaagacagctactgcagctagctcgcagggacattcaaataccactgcaactagtcaaacaactaccgggcagtctgcatccgcgacctcatcatcaactagcggccagcagacgaccaatccacagcagttaacagctagtcagattaatgattgggcttggcaacaagtggctaaggactatcaacaaacaaccgccaataagcaaaactttgtgtttaatcagtatcaaagcggtggtttagtttacgtggaagtttatgaaaataccaacgccgatgtcgcacacttagcgggtcgttttcggattaacgcccaaggtcaattggaacaacagcagttggctaaggggaacgtatggcaagttgttgcaacacagccataatggcgtcgtttagcaggttataattgaaaaatagttattgccaattgggtgttcagcgggtgtcaattttgaacacctaatttttagtatcatcatggtcaatttggtagcttgattcagctgttatcacgggtaagtgccggcaaggcccaaggtaaggtatgacaagctagcctagtgatgcctcagtaatttgaccaggatattgtaaccgccttcttgctcattgtgaccaaatacggcatactgaaagtagttcataaagattggtggctggtttgatggcaaaagagaaacatgaaatttatgacgaacaggataagcgactgggccgcttgattctgaaaatactggggatcgtcgcgattgtcagcggcttagtgggaccgttcatttacttattgaatgcaaactggggccgtgagctaggaaccttggccgtgatttgtggcggcgttgcgatttgtctgggccctaaaggtcgaactgcagggggccagtggttagccctcttgaagacgctggggttgagtattttgattttaggatattttgtgattgtcttgaaattattgggatagctaggcagtgtcgaatgcgtttctgtaaaaatggtggtcaggataatgctggcaccattttttattgtgctgaaataagattggggcttgcgctcctattattatgagagtaagatgaaaatatcattaaataacatgttgatgagaagagtagtcaggttatacctttgacagggagccgtggggagtgtaaagcggtaaggtagcgcctgatgaagatgaactcggaatgcccagttgcggtcgcaaggctgtactggcgggactggccgatactccagtgagtcaataatgacttgatgagtttaacggggtgacccgtaattgaacttgggtggtaacacgcgaccggcgtcccttgaagatggcggctttttttgtagtcatttttacactggcgtctctgtagactgcccgaccataactagattggatgggattgagattatgacaaaacaagctgagaaattacacattgaaacgcggttagcacaagctggtaatcggagtgatgatgagaagaccggggcaatttcggcgcccatctacttgtcgacagcatatcgacatgctggtttaggacaatctacaggatttgactacccgcgcgaggcccaaccgacccgctgtattttggaacgagtgctggcagagatggaacacggcatcgctgcgtatgcgctgacttctggcatggcggcaatccagctcgttttcacgcttttcaatagtggtgacaaaattattgtgtctgatgacttatatgggggttcgtaccgcttctttgacctcttacacgaccattatcatttggattttactgtctgggatgggcaggatcaagcgacattggcagcactggcagacgatcaaaccgttgccctgtggttggaaacgccatcgaatccaaccatgaaggtcatagatattacggccacagcggctaccgcacacgcccatgacctcaagttaatcgttgataatactttctatacaccgttgattcaaaagccactggatctaggcgcagacatcgtcgttcattccgcaactaagtatttagccggtcataatgatgttttagccggtgcagtggtagtcaagtcgcaggcggatgctgatgcgcttgaatttaatctggtgacgactggtgcggtccttgacccgttcgacgcttggctactcttacggagcttgaagactttgccattacgtttgcatcagcaggaggctaatgcgcaggaactcgttacggtccttgaggcagatgaacacgttgaacgcgtcttatatccaggacgtggtggaatgattagtttttatctcgctacgggtaccgacgtcgatacctttttacgagcattgaacgtaatctcgtttgcggaaagtcttggcggtgtcgagagcctgttaacagttccggcagttcagacacacgcagatttaacggaagagcaacgacaatcaaaggggatcaccgctaacttattgcggctatccgttgggatcgaaaatagtgctgatttagcagcggatctcaagcaagcgctgatccgagcaacaaaataaagcaaaagactttacttacttttagtatgtggtaaactataattattataaagatattggaggcatttttcatggcaactgcaactttaagcgacgaagaaattcgcgaacgtatcaagacgggtaaacacatgttattctttacggcggactggtgcccggattgcgcttttattaaaccagtaatgccccaaatcgaagcgaagtacgatcaatatgactggatcacggttgatcgtgacgccaacattgaaattgcccaagacatgggtgtgatggggattcctagtttcgttgggattgaagatggtcaagaaattggtcgatatgttgacaaattccgtaagacccaaaagcaagttgaagatttcttagatacacttgaaaagtagttttgaaaggcatgacgttagctgataactaaccgtgttaaaacgagccaactcgagtgcgtccatgatggttaagctttaaccacgatggacgcgtttgggttggttttcgtttgggcttctgctacactattaactattaattttggaaacggtgataaacatgacaacaaatttatttgaagatgtggtggtgcggacgaccaaatttggtgacttgcccgtattacacgtgtttgcagctagtcaagcacaaactaagttaccaacgatcatcgattatcatggttggacaaatcagacagcgactgaactgggtacggcttatcagttagtacgcgcgggttttcgagtcattctcccgacagcgtatttacatggcagtcgaaatgatgggactgatctcgatcggcatcctgaacatttttggtcgattgttggacattcagttggggaatttccacaattagtcgcggccttagtggctgctggaattagtgatgctaataaaatcggtgtcatgggaacttcgatgggcggcattaccgctgccggtattatggcaacgcagcccacggtagttgctggtgtctcgttaattggttcaccagaaccggtggcctttgcaaccgatcaagttgcacaattaccagcggcattacaagctaagctcccagcagaactaattgaacaaacttatcaacaattggcaaagtttgacttatctgaacacccagaagcactggcgggacgaccaatgttctttttcaacggtacggccgatcaaatggtaccttatcagtatattcgtgattttaagcaccgttttaaagatgagccagccctgaaggcaactgtctttaaacgcgctgaaggtggcgttcaccatgtacctcacaagattcaagaagctgctgtcgccttcttggagaccaacattcttaaataatgcacacagcacccacactgttcataaaactgaacagcatgggtgctttttattgccatcaataccataaccgtcggacactatgatagcctaaatcgcctaaaagtagtggttctgacagtaacattagacaaccgcgttccagtaagaaaatcgcgagattcatctcatcatcccagcgcgcgacccgttcgttgagccggcagttgtatcttgagcttgcctttagagccagtgaattcattttgagggggttgtggcgcaagcggggaatccgggtgaggagccagggataggccagcaggtcggaactgatcagccaataaacggggagactaaaggtcagctgccactgtccggtcggtttcgcggtaagcgcatagtacgtcattattaaaacggggagtgctgacagttcggcagtcagaatattaattgctttatctttcatcattatttcaccttgctgattggttagattaagccgatggataagcgttcgatattttccagaacaacggcagtctaacacgatttcgggccagtgtcaggtcatcgaatttggttagttaagaaaatatttataaaataatgattgcttacaattgaattttgagcaatttagatgtattctgataaccgtaaatgaaaacgtatacaataattttaaaaagaaggcatttactatggcaaagatgattgaagcgtctgttgcaatgttaaaagttattgaagcttgggatgttaaacagatttacggctatgctggtggatcgtttaactcaaccatgcacgcgttggatgttgagcaagaacggctccaatatgtgcaggtacgtcacgaacaagtgggggccctcgctgcggcagcggatgcaaagttgacgggtaaaatcggggtcgcctttgggtcggccggtcctggtgccgttaatttactcaacgggttgtatgatgctaaggaagatcacgtgcccgtacttgccttggtgggccaagttgctcatactaatatgaactatgattatttccaagaattcgctgaagaaccgatttttagtgatgtggcggtctttaatcgaaccgtcatgacaccagaaagcttaccatacgtcgtcgataaggccattcggacggcttatcgtgaaaatggggttgcggtggtgacaattcctaatgattttggatatgttgaaattcctgatcttaattacgattcagcaagtgtccctgctaaactgaccggcattcctactattgatgatgaacaagttaagacggtattaacgatgatcaagaacgccaagtaccccgtcttccacgttggtcaagggacgcgtggtgcaaccgaggacatgatggcgttagcggagcgtctgcaagtaccgattattatcactgggttagccaagggcgtcattcctgatagttttgatggtaatatgggaagcgcttatcgggcagcctcgaaagcggcggatgaactgatggggattaccgatttggtcgtttcagttggcgcagattattcgttcgcacagattatgtacacgactcacgacttcaaatatgtgcaaattgaactggatcctggcaagtttggtcggcaccatcatttggatttcggggttaatggcgatgctaaagtcttcatcaaacgggccttggcattaagtgaaccagcgtcaccgtcgccatactaccaagcggctaaagcagatatggctgactggaaacagtatttgaagaagctgagtgaacggacgaccgatccacttgaatacgaacaagtctaccaagaaatcaaccgggtcgctgccgatgatgcagttttctcaatggatgttggcgacaatacgattaatagtttccgtttcctaaagatgaatcccaagcaaaaattattgacttcagcactatttgccacgatgggtgccggtgttcccggtgcgattgcggcgaagatgagttatcctgatcggcaagccttcaacattgctggcgacggggccttctcaatggtcatgcaagacttgttgaccgaagttaagtatcacttgccaatctttaatattgtcacgtctaaccaaacgttgaactttattaaatcagaacaagaagatgtgccgcaaccatattatggtatcgacttgattgatgctgattttgctaagatagctgaaggaatgggcgtcaaaggtatccgtgttgaacattttgatcaactgcacgcagccttcgaaactgcgatgaccgaattaaaggctggtcgtccggtcctaattgatgccaagattacggacaaacgggggttaccagttgaaatccttgatgttgatccaaccaagacatcggatgcttctgtcagtgccttcaaagaaaaatatgacgcgaacgaattgaaaccactaaccagttatttcaaggagttcaacgtcgaatagtcagtgtgaacgagaggctgtgacataactagcctctgtataagcaaatgggacgagaaaccgaattttggtttctcgtcccatttgcttacgcctttgatttttaaagttggtccctaccgtgaccaatttcataatgtttaacgccagtattacgattccggcttccttggtgaccttgtcgaaacctcgcaccgagaatcgattgaaatgtaaagaagccttcatcttgccaaaaactggctcaacatcgatcttacgttgagcgtaaatctgaccagtttctggagctgaaagtaattctcgttgtttcgatttgaaatattcccaattttcgttcacggaaatccttttaagatatccttttggtgttagtgccgcggcaattagttgatgattttcatcatacttttcggcaatgtattctttaaagtcacgggtaaaaccatacttatcagtccgttgacgataagcattaaaattaaaccggacgttttgcggattgataaaataatcatctttttcatgatagtcccagttcataaccttacggtcatcactttgccattttcgactattctctttaagcattgtgccgtagggaatcaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcaggttttaattgaccgttttgcatcggatcttccttgacccgcataaaggtggcatcgtgatccgtcttagagtagctgttacgctgaccatagatcgcttgctgtgcttggtgttcacgcattttatcacgtcgtttattcaacttacgtttttgtgatttaacagtccggcgttgctgtttggctgggttcggggaaacctgcttagttgcttccacggtttcattaaggaccactaagtgatcctcaaccttgctaatcatgatatccaatagttcgggagtcagctctgatcctgccggaatttcaccgacaattttagcttcatgaagctcgcctaacagatcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgggttagctgtgataagctatcggttgtcaaagtggccagttcatcagaaattctaaagcgacaaatcgtccggtaggacggaatttggtcggcaattaaccacccagctggcttgttttcacgggcaaactgttcaattttacgactgctgaaaatgccatagcagtatgctaaaaggaccagttttaacatggtaccgaggttatattcccgcggacggccaaactggtaatcatattttagttttaaactctcaacaagctggttgatgtaacgagcaggatgatgctcttctggttggtaatccaaggcgatactcaaagtggtttgattcatgttataataatcttgcatattaggaatgtcctttcgaggataatttcgtagagtatcgggtgcgaccgatgctctttttttattttctattatatcaaaaacaggtctggaaaaatccgaagatttttccagacctgttttgtttctagagacttatgtcacagcctctttttcgttctaggataggtcaggaatcattgttaaaaggttccggtttaagatcaaaagtaaccagctaggcccgctggaaaaagttcgaatcagcgtaaacatgcttggcaaaaaagagattcagctatgacggaaaaattaaaagtcgagctctcagaatttaatcctgaaagcacgacttttaatttaacgcgtgttcaattatcggatcacatagacgtggtcgtgaatcaggtcgaatggtcggaaatgagcatttaacttggtaacggcctcgttatcctgataattagcgtggtcccaaaattgtttggaacccgtggcgccgtatttttcgccaatgacgatcaatgggatatcgtaaggactttgccgcatagcttgtaacaagtcccaatcaatagtcaatttgtccggtgaccaggccataatgacgtatttaatagttgcggcgtacttattgaaggcactgacggcatccaacgcttcaatcgtcgtgactgggtggcgtcccgtctgattgccagtttcgtgtgtccaatcctttgaatccgtggtataaattggctgaccaggatggagacgtttgaggcccttggaaatatagccgttaccggccatgacttccagaactggtgcgctgccggtgaagtcagctaggtctttcagaaatggcgcactgatgtaggcccacatcccatactgatcttcgatatagtctcgaaagttgcgtagaagttggtcaacttttgggagagcggctgatagttggttccaagccgcatcaccagcaggatcacccatggcatattgctgattgatgcgctcaaagagatggtcctgaaaatcatcagggatttctaagactggcaattgttggggagctaagccggctgccagcaagcggtcactttccaagacattattgatcagcactagaatttggggatcatccttaaataagtcgcggtacttcattaactgttgaatatacggggcaccggcttgctttttgacccgcttttttaattgttttaacttcttgggattcataaaaaactcctagtcatcaaagtgtaagtctaattcttcttggccggtcgcatccgttgaaactcgatgctggcgaccatgtaagtaaccatccatcaactgaaacagttcatagcggtcttcactggataattgttcttgattaaacgtcaacggcttgcccgataaaaagatgcgaccgaggtcatactcttcttggtctgatttacctgacaagtaatcggtcgtgacgttgaaaaattcggctaatttacgaacttctaggtaggacggggtccgtaagtcccgctcccagttaccgatttgagccgcggtattttgacgagtcgtcttgtctgcggtcggcatttgattgagggccgccgcgagttgagcgagggtcattttttgcccccgacgtagtgctcttaaacgttctggaaacatgtgctcacttccattccttagattaacggtgcggataacgccatgaattcatcgatgtcccgcttgatcaaagctacaccagcttgccagaaggctggtttggtcagatcaacaccgaggtgtttggcagctagggcttcggtcgacatgttggcggtgtctcgcaatagggcaatgtagcggtcttcaaagtccgattgtgttttagcttgagcatagataccgagactgaaaaggtagccaaatgtgtatggaaagttataaaacgggacgtcgtcaatgtaaaagtgcaacttgctagcccaaaacatcgggtggtaagtatttaaggcattaccataggcgtctttttgggcggttagcatcaagtctgacaaagtatcaggagtgacgatcccgtgctgacgggcggcatagaagcgcgtctcaaacaggaagcgggctcgaatatccagaaacatggctaacggattttgcattttagcatccaataaagttaatttggttttggcatcatcggccgctttgacactggcgtcagcgacaatcagttcggcgaatgttgaggcggtttcggccacgttcatcgcgtaatcttgacgccaaagtggcagatcttgaatgacgctgccatgaaaggcgtgccctaattcgtgggcgagggtggctgtgtcattaggtgaacccgtaaacgtcatgaaaattcgggattcgtgggtctctggtagattttccatatagccaccaggccgcttattagggcgattctcagcttcgacccaacgatgttcaagggcgtgttgggctaaagcgcccatctttggactaaattggcgaaagttgttaatgacaaaatcggcagcttgatcgtaagtttggttaggaagttgtcccaaggttagtggggcttcaatatcttgccaatctagttgatctttaccgagtaactgggccttacgcttcaggtaacttagtaaaatgtccttgctgtcagcgacaacttggtacattgtgtctagtgtcgcttgactcatgcggttgagttctagtggtttttgtaggaagttcgtcgtaccatgcgcacgataattggcaagtcggaagcccgccaagtggttcaacgtatcagcaaagggagcggcgtgagcttgccaagcgtgctcccagttgcgcattaattcggcgcgttgggcgttcggcatggcggctgctaacatgttttgagcttgacccgcggatagttgttgggttatcccgttttcatcggtatagggcacttgaatttggctaactaacgtgtcgtagtggtcactccaaccctgaaaaccgtcgagtgctaagtcgttgattagggcttcagtgtcgtcatctaggagcgctaagccttgctgacgcatttcggttaagttaaaggcgatggcttgtagtgccggttgttgcacgagcgtgtcaaaggtggcttgatctaacttaacgagctgcttcttgaagcgggttaataaattgtttaactgattatcaagttgataaatttggttcagtagtggggcggctttggtgtcgtccgcatgtgcggattgataagcaaccacgaaaacggtagcttggtcaataccggcttgaatggcttgcagactgttgacgagttgggtaaaccagtcggcgtctggtgtgtcagcggcagcacgccagtgaactaaggtgtctgctgtcgtggtcaactgctgtttaatcgtggacatttttgcagttagtgctggggaatcaatgccaccagcaaagatactgtccaaatcccacgtttcggaatagtgcataaaaagaagcctcctcaatctggtctagttatctttaattataacggttattatgaagtagtggcgaaattttcccgctcaaaacagatttttgtctcatcaaggagtgaattttaatgaagaaatggtggatcacactgggggtactcgttgttctggtagcgggagctgtgattggtgctggcagttatttttaccacgtggcaattgcccgtggtgataagtcatttgttacgcagagtacaaagctatcgaaaaaaagttcggtttatcaccaaaagtattggtatttacatgcgcgtaagcaaacttggactattgagtcatcggatcatttacggttggttgcttggtatattccagttaaaaattctaagaggactgttgttttggcacacggatttgctgggaataagggtttgatgggtgcgtgggcggggatgtatcatgaactcggctacaacgtgctggttcctgattcccgagcaagtggtgcgagccagggaaaagcggtcggctacggctggctggagcgccgcgacgacttgcagtgggccaaaaccgtcgtacataaaacggccacaactcaaatcgtgatgagcggtatcagtatgggtgcagccgggatgacgatggccagtggtgaacggcagttgccacagatcaaagcgtacgtcgtcgatagtccgtttacgagtgctgatgcgattattagttatcaagcggggcaactctatcatttacccgcgtttccgttagtcaacgtaaccagtctcattactaaattacgtgctggttatagcttcaaagaggcggatgcaatcgctcagattcgtaaaaaccacttgcctatcatgattatcagcggcacccgggatgattttgtcccgactagcatgggcaagacgctgtaccgcaatgctcaccaacccaagtctttatggttggtgaagggagccggccacaccacggccattactcagaattaccaacgttacaagcgtcacgtcgctgcattcttggaacaatacgtgcagtaatgttagcttgcttgaattagcactgatttgtcatgaatcgtgatattaagatgctaactttcaaggacaaaagcagccagctatggaccactggaaaagtgcgagttagcgtaaccttgcttagttagttcgtcctacgccgacttccaggcatttctgccaattgccgaaacgtggtgggcacagatttgagccgaaaaaccacgtctcaaatactagcctttcactaaccaagcacaggacgcttgctaagtgaaatttcaccactgggcattgtcagaaacgccttccagtcgggagagtattcgaatggcggacagggatatacccaacttttgctggatttgtcgttgcttttcataaacggtaattttctcaatcaacatagtaataattgaccgtctagacaaagcggttactgtaaccttaaattttcgttggaggttcctttgccaaaatagccaacgacaaattgtaccgagttcagtggccgttcatcagccattcgagtggcttaccgactggaggcgctgggtgacaatgctcagtagccaaattattcttagtcggaagtggggtgctttcggcttagaataagactcgtatttgagaccgggcgggttgtgcacgggctcaaatcgacgtcggcttacgttccagcaattgtcacccagccccggaggtcggaataggacgattattgctgacgaacagaaatcaaacaaacggcctcttaatatcacaaaagctcccaaatcgattcgatctgggagcttttgtgatattaagataattatgcccggtatgggacctggcaaggtacatcgacgccatctttgagtgtgatcaggtataactggtcaagtacggcggggccttgtgaatgacgagccccccaagtagttagcaactggtttaggcggttagcgacttgatggtggtccgcaacacagtctaagtcttgtgcggccttagctaaggcttgttgtaattcgggaattgcgcgtacttcggggtcactataagcgacatcgatggcgcgaattagcgcaatggcgttttcgttttttaacatgctaccatccctctcctgtgatgtggcgaacttagtccacgtcctaatttaagtatagcgctcctaaattgagattcaagttacaaatgtaaccgctgtcacaagtaacggtaggtcattattgtacttttggtatcagctgtgttatattgtaatagaaaaatagaacactaaggaggccgttaaattgaaatttgatgacaaggttccgatttattatcaaatcaaacagtatatttatcataaaatgattgacggaacgttaccaccagggtcaaagttgcccgcagtccggcagcttgcgttggacttgacggttaatgttaatacagttcagcgggcactcagtgagatgattacggaaggcactctgacgtcccaacgaggtaaggggaatttcgtaacggaagatcaggcgcatattatgcaattgagaactacactggtgaacgagcaattagcattagcgtacgaccaattgcacgcactaaatttaagtgacgccgaaatcgtggcgagtctgcaacaatacattgcccaacgagaggagcacaatcatgacagcattgacgattaaggatttacgttataaacataatcaacgaatgattttacaaaatgttcaattaaccctggcgcccagcaagattgtcggtttattaggtgaaaacggggcgggtaaaacgaccttgatgcgactaattacgggtagtgccaagggtcagggcagtattgtgatcaatggcgcgacaactgccgtagcccgtaagcagcaggtaagtttcacggatcatttgactggttttagtgccggtatgaaattacaacaaatcgcgcaattttatcaacttgtttatcctgattttgacgccaaacgctatcaagagctggttgactttctggaactcaaccaacaacaaaaattgggtgagttgtctaaggggacccgcgagaaattaatcattgcgctgaccctgagtcgcaaagtggctttgtacttattagatgaaccgtttagtgggatcgacagtatgagccgcaaaaaaattattaacagtattatcaagtggacgcctgccgaagcgacattattgattagtgatcattatgtcactgaaatcgcgccgattcttgatgaaatcgtggtcgttaaggaccaaacaattgttgttcatcagggtgcagatgagattcgcgacgaacatggcatggaacttgaagattattatgagagcttatatatgggaggtgtgacggatgacaagtagttggtcactatttaaggccctcagttggccacgctttaagcaaatgagtttattgattggtatcgaagctttggcggtgattgttactagtttgtggactgccatcaaaggaaacttcacagctgccacattattctataatttatgtgcttggatggcgttacctttaatcgttgggtttatcttattggcagtttcaaatgaaaaattcttccgggcggggacgttctggttattgccaattagcgattggcggcgctatacgattaatttagtcgtttcgttggttaatattgtttatgtttggttggtccaagtgattttattctgcttaactttgtggattggttggaatgaactgatgggaggcttaacatcagcgtcgctgttctttagccagtttgatgcgggtagtgccgtgcagttcgcactcggaacgttgctagttttagttcttgtgacgattctgatttggagcacgataacgctttgccattttgttacgaatgcgaccaagggctttttaccacgatttcggcaacggttcgtcaatgtgattatcacggtggtggtcatttacgtggctttccgcttagctaatttgttgattagcatggtcagctttctctccagtcagctagtcaaccagggacaaatcgattctttatgggtcggtagtctcgtcatgttggcagttatcttagttgaaggtgtgttgaataccttgatgttgcaaaaatgggttgagccaaccttgaattaatttagtaatcctaaaaaatcactcattcgtattggatgagtgatttttattgcgtattttttaaacgatggttgcacctaagctgtttttgaagtgacgcaacgcccattcgtgaccagcggcgtcaaaactagcaacggcatcctgatgaatgacgagctggtaacccaaattataggcgtcaacagctgtgtgaaggacacaaatgtcggtacaaacaccgactaagtgcagggtgtcaacatggcgttctcgcagacgtaaatccaaatcagtgcccgcaaatgaactgtaacgcgtcttgtcgaatgcccaaacattatcggcggcttgatgatcagcgtaccaatctttgagtggcccatagagttcacgaccccaggtaccccgaacattatgaggtggaaacaacttgctttcgggatggtaaggatcatgcggggtatggacatcggttggcagtaagacccagtcgcttgctgtagccatttggttggcgagtttgacgatcgttggtgcgagcgcttggccgggttgcccacaagtgagtgccccgccgtcagccacaaaatcattcgtataatcaataatcagtaaggcttggtgacttgccataataaaggcctccaatattaggtttgagattggttttactgtaaacaactctgatgggactgtcaattgtttaactagcgttggattaactaaataattatattaatgagatttggagctataaggacagcagcttgctgaaagttttttctgaacaataaaatattaataatattttgtggccgaccaaggcgccaggtatcgggcgttaatataaataattgcgaatggcgacttattagccggcgttctgtttgctaattgctgatctttgccccaaattggcaaagtagccgccgtcctgttttcccaatcgttaaactgagattgggttattgtcagttaaatataaaaagtctagccagcgtgttgagttcgacaacatactggctagacttttggtgggtaaacgaaagttgagtcgctggcctgatgattattctgctagttgatcagtaattgccgtgacaatttggtcaggggtcagcttaaattcatgccgcagttcattagttgtttcacggtcattaaagcgtttggcagcaccaaagttcagaacgtgcatagcgctgttgccatagtagcgactgactttttcaccaaaaccaccgctgagactggcttcctcaaccgtgacaactaactgatggtcggcctttaagttggccaaagtcgtcgtatcggggtcagaaatgtcccggggatcaatgagcgtcgcgtcaatgtgttgctcagctaattgttgttgcacggctgttgctaaaggcaggagactgcctacaccgagtaaagcaacttgctgaccagcgtgtaatgtgtgcatcttagttgcgtcaaaatcaggcgctagaggtactgactggacgtcattacttggtacccggatggcaaccggaccgttattttgatggagagcccagtgcatcatggcttgaagttcttccttggtcgttggcgctaagtaagttaagttaggaatattactgagcatggcaacgtcaaagataccttgatgagttggatcgcctgcgttaatgcggccaccggcaaccatgatcgtaacgggcaatttattgatgccaagatcatgggatagttgatcataggcccgttgcaagaaggtaccagaatggaagacgattggccgtaagccttgttgggcctgtccggcagcaaatgtaatcgattcttgttcggcaatgccaacgtcaaagtaccggtctggatattggcgagcaaagcgtttgaggtcataagttcctggaacagccgccgtaattgccgtgataggcgtcttggctgctaactcatcggctaacgtggcatgaatgacatccgtatacgtttccttggtgttgggatgcaacgtctgaccggtcgctaggtcaaacggcacgtgccagtggaaagcttctttattagtgatcgcgggttgatagccgtgacccttttcggtatggacgtgcaacacgattgggtggtcaacatccttaatttccttaaaagtcgttagcatggtctcaaggtcgttaccatcatcaacgtagcgataatcgaggccaaaatctttgaacaagttatgggaactcgtgccgttagtttcgcggagttcacggagattttggtaaatgccaccatggtcttctgcaattgccatgccattatcgttaaccagaataatgaggttagactttaaggtggccgcgatgtttagaccttccaatgctaaaccaccggataatgagccgtcaccaatcactgccatgacattgcctgttttgccctcaaggtcacgagcaacagccatgccagttgccaaggcaatcgaggttgaagtatgaccaatattgaaatagtcgtgggggctttcttctggggcagtgtagccgctgacatcattataatgagcggggtcaagccaagcttgctttcggcccgttagaatcttgtgtgtgtaggattggtgtgaaacatcccatacaaccttatcaactggtgaattaaaaatggtgtgaaaggcaatggttaattcgactacgcccaagttagggccaacgtgaccaccagtttgactaactttattgagtaggacgtgacgtaactcgcttgcgagttgtgttaattccggcaaggataattgtttcagattggccggctgatcaatgcgtgctaaaatcggtgtttccattatctatcgctcactttctcattcatgaatacttttatagattagcaccttagagccactctaagacaagtgttttgtttcaaaaatatcataaaaaatgacgccgacaagttgtcaggcgtcattaggttaccatggtcacaagattggggggcttgttgagacgttcagttggcagttcgaccaatggtacaacgttagtgtaacggacccgatgccaaatagtggtgtggacagttggtcacgttattgacattactaaacgaatttagtcggtattgatcgattgcaagtaaactaactgatcagttgaaatttgttcatagagttggttaccaagttctgagctgaatgttttattggctaattgggtctgaatgaagttatattccaactggaatgcttcaattagaagctcattttgagtttcctggaaatcccgttcaccagataggcggcgatgacgttcatcataggcgcggcgaacaatcccgatagcttgctgattgtcagcagtaatcgtgtcggctaaataagctaacacggcctcatacggcttttgttcgatctgtcgcatttgttgccacatttgccgattacgagtcatgagctcagttcgactctgaccaccacggggccggtattgtcggaacattttacgtcgggcacgagcttttttgctgagcgaccatttgctgagtgtaaaccggaaaaataatttcaagcgttcgaagaaagtttgttgattctgcagacgcgtctgactagcgacgcgcatgtacttttcggcggcatggggcgtgatttcattgttggcaaccatttcatcaatagtggtttgttcaactttgaaagtggcgtcgaacaagctcgccagttgcgagcgcttaggacgaccatctagtactcgttggccggacagaatcgcaatcactttactagtgccagcattattaccatggcgtgcttgcatgagatcaatagcgtgagttaccatgtcagctttggcggttgccaattcatcttcagtgaccttaacaacttgttttggcaacgtcaacggtaacaaaagtgttggcaccagcagactagttagaatgaccactgcggcaacgaaaataatatcgttgcgataaggaaaagcactgccattgagtgttagtggtaatgaaaaggccatcgccagcgtaatcgtgccgtgaacgccgctcagacccatcacgaatgcattacgggtcttttcatgattatcccacgcgcgaatacgggctaagtcgaagcgcgtccagagaaaacgggcgaacgtcatgattaggtagagcaagattcccagaccgactaataccgcgactgaactagtatcacgttgctgtaagtggttgatgacacttggcaacgacacacctaataacacaaagacaataccgttcaaaatactagccacgattgaccaagtcgttgtcatcacgatttgtagccgggaagtggtcaaccgtaattgatcggactggacaccatgaatgagaccggtggcaacaacagccaagataccggaaacgcctaatgattcagctaagaaatagacgacaaacggtgtcagtaatgtgtaggggacgatcacagaaggtgtatcgacccgcatgcgaatcagcatgatcctgacagcaacaatgatataaccgatgattaggccgacgaagattccaccggcaaaaacatataaaaagttagtgactccgtgccagaccgaaaacttaccagtgacgatcgcagcaatcgctaagttaaaggccacgattccggaagcgtcattgaacagtgattcattttcaagggtcgtcatgacctcacctggaatcgcaactttagtcgtaatcgatgagaccgcgacggcatcggttggcgtaataatagcgccaagggcaaaagcaagtgccagcgaaaactcgggaatcagtaagtgagtgaccgtaccaacaattaggatggtcacgatggctaacactaccgaaagcgaaagggtcgtgccaaactggtgactgagcttgcgaatgttggtgttttggccatcgttaaacattaaaatcgaaataatgacgaataggaaaatttcaggttccaattcaaaatttcgatacaatggaatcagagacaagattaacccagccccaatttgtaaaaaggcgactggaatttgattgaaacgtgcgtagacggcgttagcaacgacgacagccgcgacgagtaataagactaagaaaacggtttgcaaaccaaatttcctcctagattttgtaaagtagtttaattttaacgcaatcatatgaataaaagtattatctgcaatgattaatttggggctggacctaatgtttaaaaacagaccgattagaagttaattattgaacgttttgacctaaggtatgtcattagcttggcgtgacgttctaagtcagtataatgaaattatcaacttaactggaggacatcgcgatgttaacaattgcttatatcggcaacggtaagagtgctaaccgctatcacttaccatttgcactgaaactcaaagatcaaattaaggtgaagaccatctattcacgttcaggacgtcagaattggcaaccaattgcggacgtgcattacacgactacgttagcagatatttatgaggaccctgatattcagctcgtagttgtttcaacacctagtcatacgcactattcggtagctaaggatgtcttgaaccatggtaagaatgtcttggtggaaaaaccatttacggaaacatcagcggaagcccgcgaactttttgaattggctaagcaaaagcatttgtttattcagtgttaccagaatcggcgctttgattcggactatttgacgacacaaaaggtcattgaaagcggcgtcctcggtgacttgctggaagtcgaaatgcactttgattatttccgtccagaggttccaaccaatgttgaccatttttcattagatacgagttatttatatggtcatgcttgccatactttagaccaagtgattgcatacttcggggagccggatgacgtgcactatgatgttcggcaactattgggaagtgaccggatgaatgattattttgatatcgacctgtattacggtgccttgaaagtctctgtaaaatctagctatttccgcattaaatcacggccgagcttcgtggtttatggcaaaaagggcatgttcgtaaaggcgactaaggatcgtcaggaatacgatctgaaacatttttacatgccgaatcacgctgactttggcattgatcaacctgaaaactatggcacgttaacttatatcgacgatgcgggtcagtatcacgaagaggcagtcgtttcggaagttggtgactacagtcgggtttacgccggcgtttacgacagcatcatcaatggacaacccaagttagtcaaagatgaggaaacgttgttgcaagtgaaaatgttagaaactggtattcaacaatgccgacattagcgcttcttgcgtgttgcactagcccagctattggtacgtgtcagctttagattgttgttcggctaccagtgtgcgtcctaggaggttggtgccaattgttggcggtcggcgcaagccgacgctggctaagcatgtttacgcaaacttgagcttttttcagtgggccttagctggttgcatttggccggtattaattcgttaatataaattatgaggaggattatgatgcgattaggaattttaggaacaggcaagattgttcaggacttcttgccaatagtgaagagcattcccgcgattgaattggtgggattgctgtcaacgccgcggagtgtggcgcgagcacgcgagctgcaagccacgtatcgtattggaacggtctacacagattatgcagctttgctagccgatacgacaattgatacagtgtacgtcgctttgccgaattcgttacattatgactatgcgaagcgggcattgcaagcggggaagaacgtcatttgtgagaagccgtttacgttagtggcatctcagttaacggaactaatcgaattggcaggtcgccaagacttagtgttaatcgaagcaattacgaatcagtatttggaaaactatcaggcaatcaaacgtgatttgaccaagttgggcgacttgaaaattatcgaatgcaactattcgcagtattcatcacgttatgatcagtttaaagccggaacgatcttaccagcttttaatcctaagcttggtgggggcgccctgatggacttgaatatttataatattcattttgtggttggcttgttaggcgcaccaacgcacgtgcagtatttagctaatgttgaacgaaatattgatacatcaggcatcttagtgttgacctatccgaatgttaaagtcgtttgtatcggtgccaaggattcgacttcaccggtacgttccacgattcaggggacgactggttcgatcattgtcaacggtcctactaatacggtcgaaagtatcactgaaattgcacatgatggaacgacaactgatttagcgcttaatcaagctgagcatcggatgtatgctgagtttgtggcgtttgaacgtcttattgctaatcacgatatggtaaccgttaagcggcaattagatcattcccaagcggtcatggaagttgttgaccaagcgttagcgagcgcgggattgcaattgggctaatttccacagctaattatcaaattattatagattcgtattaatgtgattgaaaaggccgacttctcataaaattaagaaggcggcctttttaaaagcggctattcaattgtagaatcacaattcgtcacgctattttgtctgtagtgtcccatcttgaatcaacagttgagttgttttcaagtgggctaagtttgtttggaagttatttgcatacatgattgcaaagagtgtgtccaagacgtagtcaaatgagacttgtgaggcaaacgttcctagtttggcgttattccgttcgttttgtgtgatgactaattgataggtggcgaattgttgtagcggtgaatcgacatttccagttaagacgatgacaggaatatgatgtgcttgacagtatttggcaaatcgctgatgaacatcagtgttaccagcgtatgaaatgaacatggcacaatcttgtggtgtcaggctggcaatattccaggcctcatctgcatacatttcggcaatttgggcaaatcggttaattttaacgagcttattttgaaaactgcgagcccgtagctgagagtcaccttgggaaaagagcataatatgtcgtgcattgtttagcaaataagcagactttgttagcacttcaggtctcaattgatgttgagcattggcaatggcattggtttttagatctgccatttttttgatgatttcagtgactgcgtctttatcagtgaatggaaagttagcatcaacgtttgttgtggcctgggtgttaatgacaatttcagttgttagtgctcgctgaaaatcacgaaacccatgaaaccctagcttttgcgctaaccgaattatggcagaatgcgaagtataagttttagcagccaattctttaattaagatattaggcattgcatcttggtgactcaaaatataagttgcaatgcgtgtttcggtagtggtaaagtcagaacgatggcttaattgttcaataagttgcatacaatccctccaatattaacattgtacgataaatgatgggattgtgcgaaattcttaacaatcaccgggatgtttgattgacctggtaccggtttcacaggctacactagcgaagtgttaaatattggccggcaatcaattaagaatcaaaaaaataagacgaaggtggaattaatgaccaatatccatgacattgctcgattatcgggatactcagtttcgaccgtctcgcgtgtgattaatcatcaaaagtacgttgcagatgataagcggaaaaagattgaagccctgattaaagaattggactatgttcctaatcggttagcacgagatttgagtaagggacaaactaagacgattgggatcgtcttaccatatgcgaaccatccctattttgcccgaattgttgatgggattgttagtgccggttttgcaaagggttacaaagtcacattgttgccgactaattatgatatgacagtggaacgacattaccttgaacagcttaagagcaaggcttatgatgcgttaatatttacatcgcgtagtaactcgttggaggcgttggagcgctatcagaagtatggtcgaattgtctgttgtgaagatccaggaacgagtagtcacttggctgcagcttataccgaccgtttagcatcatatataagtgccttgatgtgggccaagcaacaaggctgtcaaaatgtaggggtggttattagtcgggataatttgatcagtgccagttctcgggtgacccgaatggcctatcaagaaacgtatggaaaattaccagcagctaatctgtttactggtgcggtcactttcgaagacggttatcgtgcggggcgctactttgcaaagctgaagccatctgttgatgccattttagcgaatggcgacgatattggtgctggtattcaggactattatcgggtacaccagttaacaccggtaaaaattattggacaagaaaatctactttccagtcgacttatgcagttttcaacaattgaccatcacttggaagcattaggaaaagctgcctttgagttgtcgattagtcatggtcagaaacaccaattaataaaatcagaatttattgaaagataggtcggaggaacagttatggtagcaaagttagcagtttttgatattgacgatacattattagcaagtaacaagacgtttttaaaaagtacgttgacgagtattaagaagttaaagcaacaacaaattaatgttgcaattgccactgggcgtaatctggcgatggctaaggcagtcattcataagcttgacctgaatgattttgtgctttgcaatggctccgccgcatttgccaaccatcaacaggttcatgaacatacgctctcgcgtgataacatggcaacattagttgccgctgcggatgcgaataatattgatattatttttgagtcgttagatgggttgcatgcgcacacgcatctgaatgaacaaacccgacgagtactacacacttttcgggcaccgactgttgaatatgcaccaaattattatttggataatgatatttatcaagcaatgatgttttatccgcaccagcaggacgctaatttaccgcatgcagatgaattctcatttgttcgctttgatgttaacggtgtcgatattattcccaaagtgggttcaaaggcgcagggtgtcgccaaactggccgcatcgttgaaagttgctcctgaaaatgttgttgcatttggagataatcaaaatgatcgtgaaatgttgcagagtgccggtattggtatcgcaatgggaaatgctgcacctgaaattaaagctcaagctgatatgacgacgactgattgtgatcacgatgggattgaaaatggtctaaaatcaatcggttggatttaaagatggtagcaacaggggcatattagttgagtgtgaattatgattaaattgagcagttgaataactatgaatgagctcatacttaattgttaatcaatgtagaaaactagcgggggacgtgtcctgattgactaactgcgccccactaattggcacattgttttcatattttccgtgctactaatctgtcatgagataaataacgtcacaatggtgtactaatcatcattgtgacgttatttttaatttaatttgtcatggtagtcaagttctgttttttagcaagtgagctgatggtgcttccctgaccgtaaagtgattcccagtcagttgtaaaatcattaatggcagcactgatagccggtgccgaaagagccgtttttagaatgtcagcactcatcgttgcagcttgggcacccatttcaaaggctgagttgacctgctgtacggtgtggaagctggctgctaagattttagtgttactgttttcgcgtaaaatctgggtcaaaagctcgccgataacttcatcggcattaatattcatattaaccatccggttgtaataaggtgcgagataatcggcacctgccgtcatagctagataaccttgaaacttcgtataaattgcggttgcggtaacattaataccagcagctttcaattgtttgatggctgctaatccagcttcatttgtcggaatcttaatataaacattttcatcaacatttttaagaatcgtatatgcatcttgtaacattgcatctgtggtttgaccaacggcttgaatgtggagtgttgcttggtcaccaatgatttgtcgaacagcccgcatatgcttgaaaaagtcaatgcgaccttccttcttaacgatcgaaggattagacgttacgccgctaagtggtatgatatccacgtattttttaatatcttcaatgtgtacagtatctaataagaattccatgatagtcacccctgtttttatttacaactatatgataaccggttatggaagcgataccaataatctgcagagtaataatcgctagaatcccgttataacagggatgagcatctttttatgattggaaaatgcacaaatgtgctaatcgcccaaatccagcactctttgtgcagtctcggcatctgtaactagtgtgtttaggacccccatttttaagagcgctaagatggcgggggctttggttagtgaacgagcaattccgattgaattagggacgtgtgctaattgtggtagcggaatcgcgattgtgcgatcaagcaggtcaccagtcagaattttgccatgcttatcaaaaaaggtacaacaacaatcaccaattgcttgtcgttcctttaaaagttcacggtcagtatcggttaacagatcgcgccaacggctactggtattggagagtggccccccaataccgagtagtgcaatatctaggtggttccaacaatcacgaatttggcggaagtaattggatgtcaagataccatcgcgaatgtatttggattcttgaactgcagcagcatctacaaataaactgtgaccaccaaaggtacgtgctgcatcgtagacgataccattaacgtggtatgctgcattcgatgggctaggaccaccgactagtggtacaaaagtagcatcagtttgaatagggtgctgcaattgtccaatcataccactgagaattgacccccaagcaaaaccgacaatgttatttggtttgatgatttgtttgaggtagagcgcagcttctgttgatagtagctgttctttacgctgatgattagcgtgtggctcgccagcgatgacaacagctttcttcaagtggtagcgttgcttgagttgttcttctaaggcaaataaatcagaattaaaatcattgattttaatctcgacaatgcctaattgacgagcttgttttaacatgcggctaatggtagtgcgataaatgtttagctctttcgcaatctgggcttgagtatggtcacgctcataatatagataagcgaccttggccagtaattgtcggcgattatgactcatttggaagacttctttctaagagtgacgaacaaatccaataattatacttaatacgtattctgctagttaaacctgtcatggactatgattaaatcgggttgttgcttaagttccagcacggccagcttagtcgatctggaaaaggtctgattaggcgtaaattcgtttcgttagtatgttagacgccgtttacacaggattcttaacaaacgttgaaacgcggttgacgtcgatttgagtgcacgcggtccaatcactgcaactgcgaataaattggctaatgaacggtaatgacgaacatattctatgggccacttgaatggcaggtaaccgactacagtgagtgttaatcggttttgattgattgcctaattgattattggttgcacagatgactgctacaaggccatactgttagtatgacatacaatgatgtggcgtgacaaaacaaattaaatcactactaaataataagctaacgtcataaaaaccgatttttccagaagctgagttctagaaaagtcggtttttgacttcttaattgttgctccaagcgaaaccagctgagagtggattggtaggggccttaagacaatactttttaaattacttggactagcaaactatatagattatagagactgctccgtccgttcgataatatcatcttgggtttctttggataggcccacgaagaaggcggaatatccagcaacccgaacaatcaagtcacggtgcttgtcaggatggttctgtgcatcaatcaaggtatcccgtgaaacaatgttgtattggacatggtaaccatgaagtcggttgaagaaggtccgtagtagtgcaaccaatttcatgcagctttcatcactccgtagaatttgtggtgacatcttttggttcagtaatacgccaccagtgatgtccttagtggataacttggaaactgatttgaacacagcagttgggccatcagtatccattgcatgttctggtgagcaaccttcggctaatggtgtccgagcgtgccgaccatctggtgtagccaaagtgctgtgcccttgaccaacgttggccgaaatagaagaggttcctgcgtaacgcaagccaccaatagggccgcgaccgtagcgcgtgtttttgtacttggcaatttcatcaatatatggtttataagcttcaacaatcaaatcatcaacataatcatcatcgttaccatactttggggcatcattaatgagcatctgccgaatcttttcaccgtcttcatccgcaaaatcagtggtaagtgcgtgccaaagttgggttgttgtcaacttcttttcttcaaagacaagtttcttgattgcagctagggagtccgctaggttagcaataccaacttgtaatccactgataaagtcgtataccgcgccaccttctttaatggtcttaccacgaccgatacaatcgtcggttaaaacggagcagagaatatcaggataattttgttccaaagccaaatcacaactattttcgataatcacactttgtcgtgtcatttcacggagcgctttgtcccaagcagtcataagttgatcaaaagaagtcatatcagtgaacttaccataatcgggtaataaccgtttgccagattcaggatcaatgccaccattcataatgagtaagagaacgcgtgggaagttaatgaagctcatcccggtgcaacgatagccccattttccagggatcgctgtttcgacacaaccgatggcactgtaattataggcgtcttctttcttgacgccacgacgaataaacgacggaataataatttcgtcgttattaaacgcaggcatacctaagccttgtttaataacttcgacacattcacgcataaacttatcgcttaagccatggtgataacggaccgttaagttgggttgtggtaaatgtgcttgcgcaattgctcgtaaaatcagataggacgtcggattaacggcatctttaccatctggtgtttgaccaccaatcgtaatgttttggtagaggggactccctgcagaaaattcagtatgttgccatgagcgtactttattaatcgttaacgtcttaagacataagtttgtgagtaattcggttgtaccgttggcgtcaatagcaccagtttttaaatcgtgctcatagaatggagctaggtactgatctagacgaccatatgagacagaatgaccgttggattcgatttgtaaggtcagatgaactaaccagacagcttgaatcgcttcataaaatgaatttgcaggttcgtaaggaaccttgtttagaatttgggcgattttttcaagttgtgctttgcgagttgcggatgtcgtgttttgagcttgcttggacgctaattgggcgtaacgtttagcaaaattgtgaatggcatcgattacaattaggcccgctttatagaaatagtattgtttttgctggttaaaatcagtaaggtcaagattagcaagtgctgtcttaatgcggtcttcataccatttaagtcccttattaacaacgtttttatagtcgaccgcaatgtgaccatcaccagaagtgatattaccatcggctccaataatacctaaatcataaaaaatacgacttgcttctggaaaactagcgtagccgcggtcttccaaggtattatgtttccagaaaggcgcaatcgcacgaagttcttccttagatttctccgtaatatagaaaacgtcaccaggacgcttctcaaatgtatctaattcatcaatgacccaattcatagaatactcagggaatactggtgcccaacgattttggcgtgcttggttaccaacaattaaagtatcatcttcaatgaagatactcattttatcaagaacgtgttcaagcattttagcccgtaatatatcgacttgttcgtcttggtgttgtcgataagtttcggttgtgagaatcgcccgttctggatcgacataaggttttgcatcaatgatgctatcgcgtaagcgatccatcattggcgtcaatttaccgaagtggttaatagttgtcgttgttttagttaaagtttcagacatgatcattcttcctttctatcgttagaaactgaaatgactttcttacgtaataatcatagcatcttttgactagaaatatcatcaaaataatgaataattataaaatgcacatttgtgcaaaaatcaatgaattaaagaagtgcgtatcgaaaaaccctcatcgaagtcgatggggggtagcagcaataagtttgcggtttgagtcgcttcggtcattgcgacaatttgcttaatgagtcgcaacagtctggactttgatttgttgaaaattgagtacgcgatgagcctcttttgaaagctggttgtcggtaatcactgtatcaacttgctggaatggcaattggtgaacagtactggttaattcaaatttacttgaatctgttaagatataagtcttgtcggcgttatcagccatggcatggaccgtatcagtgcgcataatatcattaccataaaagccgtagttacgatcgaaaccgtcaatacctaaaaaaagcttttcggtgtgaaagttagctagcatcgtttttgttagtggtccaactgccacttgggcatcggattggtattgtccgcctaaagtgtagactgtaatattgtcgtagttacgtacgtaattagcgatgaaaaatgaaattgtaataattgtcacgtgtttcccactttttcctagttcttcggctaaaagtgcacaagttgatcctgattcgatcatgatggtctcattatcttgaactagagttgcggcggcttccgcaattttatgtttaatgtcgtaattttgagcaagtcgaaagttcagattgtttggattattaataattgcaaaaccatgttgccgttgcaatagaccacgattttctaattcagtaaggtccttacggatagtcacttttgagacctcaagtaagcttgctaactcattcacttcgactttttttcgttgattgacgatttctaataattgttcattgcgttgattcatagattttcacttccttgctttaatgattataacattttatttgattgaaaattactttcgtttgaaactaaaagtatttacgtttaatgtgattggtgttattctgaaggcaacattaagtaaaggagtggtcataatgccaacgatcacaactaagacgcccgtaaaaggactaatatttaacattcaaaaatttagtatcaatgatggaccaggtattcgaacagtagttttctttaaagggtgcccgttacgctgcaagtggtgttctaatccagaatcacaatcaggtgagcaagaatcaatgtatgatgaacagaccgccaagcaaaccatcgtcggtgattatatgacggttgatgatattatgaaagttattctacaagataaagacttctatgaagagtctggcggtggggtaaccttctctggtggtgaagttctttttcaagcttcctttgcgattgagcttgctaaggcagttaaagcagctggcattaatttagcctgtgagacaactggttacgcacggcctaaggtttttaatgaattcatgtcttatatggacttcatgtattatgactgtaaacaatgggacccagcccaacatcgaatcggaacgggtgccgataacggggtaattttacgtaacttagcaactgcagtgcaagctcatcaaaagatgatggttcggattccggttattccaggttttaattatacattgaatgacgcggatcattttggacaactatttaatcagattggcgtaaccgaagttgaattattgccatttcaccagtttgggttgaaaaagtatcaagatttgggccgaaaatatgcgctagttaatgttaaacagttacaagcggatgacttaattgattatgctgaacatattcgtgcacatggtgttaaagtacgggtgaatgggtggtaagtgccactgattttccactgtgatttttgggtgcgatgtaattttgacaacgacttctaaattgaagtcgtttttttgttgagattcttaaacaaatatgactgcactaaagttttctttttttatataacgcacaaaagtgctaaaagggtcattttataagtcaattagtggtgataggtatgaaagcataatgagttgatctagtgcgtttttggtcgtaataacaattaataatcagatttaacagtgtgttcaaccgctttggaaaacgcttacatatttgtttgataccagtaaggtatggtgtaaataaagaaaagggtgacgattgaatgtcagaagaaccacgatacttagcagtagatgttggcgggacaaatttaaaatatgccttaattaatcgcagtggtcaaatgattaaaaagagtcgaatggaaacgccacacgagggattaacacagtttttggaagcaattgaaaagattagtgacaagttgaagggccaattaaacggggtggcttttagtacacctggacgtgtagacacgacaacggatacgatctattgtcgcaattctaccctgccatatttgaatgaagtctgtttaccacgaaagttgcaaaaattgggactgccaatatcagttgaaaatgatggtaaatccgcggcgcttgcggaatcatggttaggaaatctgaatgatgtcaaaaatgggatggcaattgtacttggaacatgtgttggcggtggaatcatgttggatgggcatttgtgggctggtagtcgacggttagctggggaagtcagcttgatgcctgctgaccagaccaatctggctgatgatgggttgtttggaaagactggttcagcggtacgaatgattgaagctgttaatacggtaattggcgcgtcttgtttaacagatgggcactgtgcttttgcggcaatcaatgctggtcaagcacaagcgacacaaatttttcgacagtatgctcgtgaagtcgcagcgttaattcttaatgttcagacagtcttagacttggatcgatacgttattggtggtggtatttcatttcaacccattctgattgatgaaatcaatcggcaatacgattggattttagaacgacgaccatgggtgaaaagtaccattgctcgacccgaaattttgagtagtcgttttcacaatgatgcaaatctttatggtgccttgtatcgattattcaataaattagatgccaagcatgatgttccgattgatcttgataatttgttagtcaatgcggggagatgaaaaatgatttttttgattgcgattattccagcactgtgttggggcatcaaccccttattagtcggtaaaattaatggtcattctgaaaatgaaatgtttggtatgggtatcggtgatggacttatagcccttattttttggttgttctcccaacctactgtaacgatatcgggagtcacatttgggttggcaatgatttcgggtgctgcgtgggccatcggacaattaggccagtatatcagttatcgcttacttggtgtatctaagacaatgccgatttcaacggcgcttcaattggttggaacttcgttgatcggtgtcttgatgtttggcgagtggggaagcagtaaccaaaaaatattaggactattagccattatgttgattgttgccggttcagcattgtcagcgggaacctcagatggtcggaagaaaggatttagttgttatttgccacttttgatgaccaccattggttattggatttatagttgtattcctaagctggttaaagttgacgcattacaactttttttacctcagatgttgggaatattgatagttgcggtcgggtgggcaatatatcatcagccaactgtctatcgggataagcaaagctggcaaaacacgcttccgggtattttatatggtattgctgctttcatgtacatcttatcagctcggtcaattggggtgaccaatgcctatattattggtcaacttagtgtggtgatttcaacacttagtgggctgttctttttacatgagcgtacgggtcaacaaagtattgtgagcgtcgcgactggtttattgttcatatttatgggctgcgttacgacagcattaatttaattgatgaagcaccaccttcgagttgagccatcgaattcaagccaacaatagtaaaaaagctagtttcgcaataaaagatggcgaaactagcttttgagttatgtgttaccagttattgagtcgtggacagtgatagaacatacatgttgcctagttgtttacctgatacagctcattattaggataatgcgtcatttaaacgagcacgtttcattgaatttctgattgacagcagagacgtgctctaatctaattgcgagactgagtactagattggttaactttttgagtgtacttcggtatcatcttgagttcgcgtgcagcacattagttatcgcgtagcatcttcttgatcgccgctactgaacgggcgacttgttcgggatcaactggctttttttcagctggtgtcgagcgtacagtggccgattgattagacttagttggtgttgggttcgacatagtcggctgtggcacactagttttagctggctgtggactaattttagcaccagtcgaggcttgggccggctgaccagcgtgcatttgatccatagtttgattcaacaaatgatcgacaaagacattgccctgattggtagcgtggcccttagtccagcggtaattaagtgcagtgaatgctggaagcaaccggtcgacttcacgccataactcagcgttaactaacggaccattgctgcgtttccagccgcgtcgtttccaaccagccagccagcccttagtgactgcgttgaggacatactgtgaatcaagtacgaacagaatcccagtcttagtttggccaagctgttgcaattgttcaagagctcgtaagaaggccatgatttccatgcgattattggtggcaccccattcgccggcagagtcagtgacgagttggtcgggcatttcaatccgataagcccaggcagccttatcatcttggtgcacgtgctgaccggcaacgtttccggtatttcgcgaaccgccatcagtataaacagtaatggctgcgttgaccggcgcttgattagatactgattttgagtgagctggtcgggttggactggccttaccagccataaaatcctgagcgtctttctcgcttgtgaagctcttgtactgtgcttgtggataaccgctaacttgcttttgagtttcgggccaggtgcggtaaataccaggttggcgtcccttacgaacagcgtaatatttttgtgccatggcgatacctactttctgaatggtgatactgctaatttaacataaattgccggggaaaaatgaaaaattagcagacttgtaaataaataataacaaccggatcacggaagcgaacttctgtgatccggttgccatgatgaaatataactaatgggctttaaataatgtcgtcaggtaattcatgaatgtcttcaaataacgatccttgtcgaccgttaacgcaaccgtgacgttagttgggtcattgagtcgcgcagggtcaccaattgtccggccataatcttcaccactagcctggacgtacatattcaggtctaacgtggtgacaaaacttggatcgagtgaaacgccgactgccagtggatcgtgtaaggcacaaccgtgtaagtcaggactcgtaatatcgtaagccgcaatgtaatagtcaacaatgtcagcaaatttttcgcccgcagttgtctttaagtcccgccattgttgtgtttcagtcttggttaataatgtccgtaacgttacgtcgagtccgaccatcgtaagaggcatcgtactggtgaagacggcgttggccgcttcggcatcttgattaatattggcttcagcgtagtgactgacattacctggaacagtcagtgcaccacccattaaggtcacattaccaatggtgctggcaatgtctggtgctttttcgagtgcttcggccaagttggttaagggaccggttggcactagggtcagatcggcgccatattggtgaacggcatcaattaagaagtcgacaccggactgcttttccacggcgcgtttcggttcaggaaggttcacgtcgccgataccgttcatgccatgaatctgctgtgaaatcggcataacgtcaaagtgttccgtcgtactggagtggggttcacctagaaagacgggtacgtcagtggcacctagtagttctagaatttgtaaactgttaatcgccgcctgatccactaggcagttcccataagaactgataatcccaattaaatcaacgtcgggtgcaccgactgcgtaggcaatggccattgcgtcgtcaatcccggtgtctaagtctaaaatcattttacgttttgccatgtaaaacatcctccctgattaggtctgaagcgctataaagctatgttttaattgtaaacgtttcagctgatgctgacaacggctagcggcgaattaaattaacattgaacagaaaaatgttcggaaatatttcacgaccacgcttactggcgaaatgttgaaggctgttttatactgacaattaaggaaggtgaagctgatgacgacgaatagtccattagaagcaatcatgaatgcgcgccattcggttcggcaatatgacggccaaactaaaattgggcgtgaagaaatggccgcgatgttacagaccgcatttttggcaccaaccgcattgaatcaacaaccgattcgggcgttggtgattgaggatgcagccttgcgacaacggttgtgtgccgcgactggtaataccagtcagttaactacggccagtgccgtcgtcttatttgtgctggatcgtgaaaatcaacaccaagcgccagcgtttcaggccagtcaggggcaacaatttgatactggtgacgagaccattggcgccctagatgctggcctgattgcgatgcaatttatgttagtggctaaagatcatggctttgatacgaatccgatgaccgggtttgatgctgccggattcacgtctattttggaacttgacgcccagcggtatcggccactattgctcgtttcaattggcaaagcggccgttgctggcaagccagcagatcatcaaccgctagcgacattagttgattatcgataatattgaggggaagctagaacgtgaattttgaaaagcactaccgatatactggaaagcaaaaattaggattaactaaattagcaacggcggttgatccagaatttgaagacgaaaaggtcatcaaggcgcaaatcgccaagaatattaagcaactgactgaactgcaaggtaagttatatgcacaagaccgatttggtgttttagtcatttttcaggcgatggatgcggcgggtaaggacagtatgattcgccatatcatgagtggggtcaacccccaaggctgtgaagtcacatcgttcaagcaaccaactactaaagaaattgcgcatgattatttatggcgaattcatgatcgggtccccaaacgcggcatgattgggatcttcaatcggtcgtattatgaagacgtacttgttagtcgagtccatccggaaattattgtgaatgagcacgtcggtgagattaacgataagaaacaagtggatgatgctttttttgaacgtcgttttaacgatcttcggtactttgaagattacttgcaacacaacggttacttagtgctcaagttcttcttacacatgtcaaaggcggaacagaagcaacgttttattcgccgtattgaaattccaagtcacaactggaaattctcagctgccgatattcaggaacggcagtattgggatgattatcagcgtgcttatgatgatgctatcaccaagacggctactaaagcgacaccgtggtacgtcattccgtcggatagtaagtggtattcgcggctctgtgtttcggaaatcatcaatcaacgcctgtcggaattgccattagcgtatccctcactggatgcgagtgcgcaagcacaattaaaaacggcgctggagcaactagatcgtgagaccgactaacaaagtatcgcgcagtgttactagcagcaagttgaaattataaaaaatgagctactcacaccgttgatcgtcagttcaacgcgacgtgagcagctcatttttttgacggtgtgacaagctaattatgaatgccgatgcttagttcggcgtgtcaggacaaaagcgctaccgagtaatccaatcaataaggcgagaccgatagctactgaccaacttgccgagtgttcgttagtttgtggcaacgacttattcatcggtgctgagcctgcaaaagctgtagctgccgatgctggtaagggattagttgccggaaccgttgtggcggtcgtgttagtcgaatttgtcgctggattggcaggtgctgacagattaccactgacgcttggttcgggggtcgatggagacgtctcatttggaacggctggagtgacggccgttggtttttcaggtgttacggttcctggattggtgggcttaggaccactcggctgttctggtgagacggtacccggcttttctggttcagtgattccgggtttctccggttcagtagtcccaggtttttctggttcagtgactccgggtttctccggttcagtagtcccaggtttttctggttcggtgactccgggtttctccggttcagtagtcccaggtttttctggttcggtgactccgggtttctcgggttcggtagtcccaggtttctctggttcggtgactccgggtttctcgggttcggtagtcccaggtttttctggttcggtgactccgggtttctccggttcagtagtcccaggtttttctggttcggtgactccgggtttctccggttcagtagtcccaggtttttctggttcggtgactccgggtttctcgggttcggtagtcccaggtttctctggttcggtgactccgggtttctcgggttcggtagtcccaggtttttccggttcagtaactcctggttcctcatcttcatcgggatctgttggttccgaaatacctggattttcgggaacgtccggttcggtgactggccgtgaaatcgtggctgtcgcggatcccttgttgccgttcttgtcagtataggtgacattattttcaaaagttgcgtcgccagtgggttcgttagtcttagtttggtaggtcaaagctaactctgacgtaaacgaccctgtggcattaaacgtcaattgattaccattcacgctcgtattgacgggaataatattacctgtctcatcgcgtaggacggcgctgccattgacatacgtttggttcggactcaacgtatcaacaaaggtgggatcgacgagctgattgttattaggcaagacacgaattgtccagttgatccgccgtggattagcttcgtcagcccattcagctgatttctctaataaaattggggctaagttaccaggatgactaggaacggttccgaaggcgtccaattgaacaaaccctttccgattacgtggtctggtttgataggcctgattaaatgtgacgagacctgtatgtgcgccggcagcaatgaagaaggttccgatggtacctgcagtggttcctttcattggaaaagcctcgtcatgcggaatacgaacgttttcggggacttggaaagccatcgtgtcgcccgccttgatcttgaggttatcagggatgcgccagttgtaattgactgtgtattcttggtcttctggcaattgtgcatcgtgagccattatcttgcccttactatctttgataaccgcactattaacatcgttgcccgttgcttcaattacgttgcgggcctgactaactaagggtggcccgaacatcaaaaagaaaattccagtaagtgctaataataaccatcgccattttttgcgcatggtaatcgcctccattaagatatacccatacattaccaccgttgtacataaaaatcgttgacaaaacaccgtttgctagcttaactaacggtatgcggccagatttagcagacttttttgtgattgcgttattaactgatatgtgatgttttaggataccagaaaagacaccatttgccatcccatccaagggacgtaagggtgtccgaatcctgttaaattagaagtgtggcgtgcttcaggttgattggcagcacgcctcgatgaattgatcagttgccgtacaagaactggatgatgagtaagtcgacctgtggattgatatgcaacattgagtggctggcggtcaggggactaccgtgaatgatttgggtttttggtgaccaaccagctgccaataattgatggctgaatttaagtacggcttgtaaattgacgccgccatcaccacttgtatgccaaacatggccggcaatattcaatatcggcaaggaccgtggtaaccggtttaactgctgagtggtcaagcccggataggtcgagccaatggtcacaaacttattgatttgtgcgcgctgggggacttgcgctgtcagataatcaaagatgatattacctccagatgagtgaccgacagcattgtagcgggtcacgtggtagcgctttgcgagcccttgcatgacagtagcaaactgccgagcttgacgtttcgcatgatgattatcggcaaagataacctgaatcgttgggttgttttttagtggtccgaactgttggacagtcacgtggccggcgtgactaacatggacgaccaatcctttcgtcatcaggtgtgccgcggttaagcggtgcacaaagccgtcggtagaaaatgcgcgcgcgtaatcgccaccgacgaagatggtcggaatactcgtttgggcgacccgcgtttttcgtaatggggtcaagcgatgttgccaataggatccaatccctacgaccagggtcgcactaataatggccatgattttaataattttaattcgtcgcatcactgatccacctcgcctttgaatcctattatagtcgaattagtaaaaattgcttttgcaaaccttcgccgaatccactagaatgagaagcaataagtctacatagaagagagctgggaaacgatgagtgcagaatatgatttaacaattattggtggtggcccggtcggcatgtttgcagccttctatgctggtatgcgtaatgcacgggttcagttattagaaagtctccccgaattagggggtcaggttcaggctttgtatcctgagaagatcattcatgacgttgcgggatatccggcaatcaagggccgtgaactggtggcacaacttgaaaagcaactcacacaatttccaattgacattcaattggcgagcccggtgacggatgtcacgggagcgatgggtgatttcacgattaccacggcgagtggacagcagtcacattccaaagcgattatcgtagcgactgggagtggggcttttgaaccccggcgcttagcagtcgataatgcggctgaatttgagaataagcaattattctaccacattccaagtgtcaagcaatttgcggatcgaacggtactagttgcgggtggtggcgactcagccatcgatatggccttgatgcttgaacccgttgctaagcacgtttatatcatgcatcggcgtgatcggttccgtgggatggaacacaatgtggacttgttaaaagcgtcttccgttgaaatcaagacgccatttttgattaagcaacttgcagagacggctaccggacagttacagctgacgatgaaagaggttcgcggcacaactgaagaaacattggccgttgatgatttgattgttaactatggctttatcgcggataataaagtcatccgaaactggcacgtgaccccaaccatggcccaccgactcatcaccgttgatacggagatgaataccgacgtacctgggattgcggctattggtgatacggtgacttacgcgggcaagttaggcttgattgccagtggcttcggggaagctcctaacgcggtcaatcagttaatgatgaccttgtatcccgaacgacggagtccactgcatagtacgaccgtgtttgaaaaaatgtaagtttaaaagagctgcgatataactggcgctatacaagcaaatagggggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgctggttcttgataaagcttttaatattggtcattagctgaggactgacattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcgcaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagctttgcaagcacttgtaagcttccgttagtagcttcttgaacaactaaatcagtaatatttgggtctttaatttggagcagtactttagtagaatggtctagggacatatctgacactcgctttcaattggttttggtcgacttgattgtagcacaggacgatatgtccttttgttgtacataaaaatagtgttgatggattttatccatcaacactaaatatcatagaccccaaataggacgagaaaccgaatcttggcttctcgtcctatttgcttgttcctttaagaacccgctttattggcggcctgttgtaccatgaagtggtagaaaggcaaatgtttttttcaatctagatagctttggtgtgtcttaaaataaaaagacaaccggtcgctccggctaaacttttacaatgtataagtttgtacaaaaaaatacacaaaatttactgaaaattgataacgataaagaaacgctgttgttaagataaattcgtaacatactgcctgttgttaacgtagaatttgagaggatgattctgtttatggcaaaaggttccattattgatggtgtgttagtttagatgattagattttatatgtcactaagtgttgtgaagcatacgatactttatttgtgttttatttttctattactgtatttaaaaaagcgttatccagacaatgtaattatcggtttttttttaaaatacggtggtgttttattaatagtatgcttcatttacattttatcgcaatttggattgccggttaccgcaatcgatgttccaatagttcttggaattttaggtatttcggttgttgtgttgagacacaagcaaaagtaggacgaactgctaccaatctgttgcttacggagtcatgataactcatggctctttctggtttttatctaatattgacgtccctgataacgtactgtcatcaaaggacttcatggttcagaccctgtttctgggtcattccatatgagcacctaattggcggtaaaagtattaaaaatcagtggctgatcaactatcggcattcgtgcgctttagaaattaaaatggcagataacccggagcgctgagcactttaatacagttttttaccaacatctcaatcaccgcgacggctaatcagatcaaaaaagcgctatccaaatgcacttatgcattcagatggcgcttacgattcgtcatcagctggaagtcactttttcagcaacgacatcattcagaattttcgtggttgctgaatgatttatgcactcgctgtgacagcaactttgaaataatgtggattactcgttgctagttagacttaattcattcataaaagtcaataagagtttggcatagctgggatggtcggtgttgctcttaacttcttgctgcatttccgttagattatcagtgactacgccggtgacgcccatgaacatcatttgatccatttggtccgtattatcaatgtcccaggcgtaaaccgtcttgtgattgcggtcagccttgtcaacgaattggtcgtttaatgtggtgacctccatggtgtagccgttcgcgactgtatgcgggaacgtgagattataaggcaagatgtaactaacgaattgtttttgatctaagcgtttcaagtcacgcatgactttgaaactaagcgtatggacttggtcatgatgagccagtagggtcgcaccataacgatcgatgaaccgtttagtatcggcggcggtgtaagccgagctggtcttgatttcgactaatagtttttgatgatgcttgtgagccgctttcaggtaagcatcgaaacttggaatctttgcctgatagccattttcacgaacagtaattttttctagttgttttaatgttaattgagatggctttttcttaacgccagctaaggcttttaaggttggatcatgcatgacaacgaattgatggtccttggtgacttggatgtccatctcaacgtaatccggatgttccttgctggtcttgatcagtgcaggaattgtgttttgcacgccgttaccgttatcgacgccgcggtgggaaatcatgattggcttggtaattactagtccatttaagtagactaaattaacggcaactagcaaacttgtcgctaacagcaagccaattgcaacactcgcccgagtcaatttgcgcaaccgtggtgcctcgttaaagtattgcggttgttggcggaggagtgtaaagtcttgacgatagcaaacaataattaacatcatgaagatggccgtggtataacaaataataatttcggtgattgcttccatgataaagagattaacagtggcagcggccatggcaaaacttgttttatcgaattgaagctgggctacgtaaatcaacgtataaatggtcgtgacgatcagaaaaatcataaataaggtcacaatcatggtccataagtagcgccaaagatggtggcgcgtttgttgccaactacgagtaacggccgttttccatggaagccgatcgacaatcattagcggtaataggctaattaggcgaattccaaggtaaccagccagcaagtagaagcaccccaagccgagcgtcatccacgggttttccatgagatagctgacaatgaaggctggaattttggccttgttgagtaatggtgttgtaaagatgaaacttccaaatggcaaaatcacaataaagtagccgataaagaataagaaagtgctgggtgaggtgccagtcagactagtgaccgttgaccgcaagaccgcgcgtacagtttgtggtcggccacgaaagatattcataatacccagtagcagaaacgcaaattgccaataaactaaaataataatggctaataagatcgccaccataccgagtgcggccagtggttggtgaataataatactaccgatattcgtgtacgagacataactgacccgttgccacttgagtaacatttctagcacccaattaaaaaaaggaattgctaggtaactaatgaccaaattggtactaaatatcagggcaacgtaactgccccagttcttataaaaacggcgggtactatcccaccaaaaacgccaagcgcccatgcgtggtgcctcctcccttgatccggcattgacgaatcaagtcattattaattttattgtaacacgcattgtgttagttatttttatctaaataattgcttagattagtcactctaggaaaccactttcaactaagcataatggggctaccgagcacgtttcggtaatccgcgcgaatggctgatgaacggcactgaacttaagagatggcacgtgttaatcatcgttaatgcgcaagcatgagacaaaccacaattagtattttatcatgcaaccgatgccagatggatgagggcagcgtcatatttaaaggagatcataaaaaggcgcgatggcaaataaattgccgtcgcgccttgcattgtaaatggaatgcttgttgctatttggaactgctagagctagtcgtggtactatccgtatcatcagggttggtaatcttgatacgagtagaatcagtcttcttatgcgaagcttccggtgcgtcggtcgtatacaacgagtccgttgacttattaccattcttcgagtagagactggttgacttgccagctaatttattttgaatctgaatttctttttcaaggccatcggcgtaattgtaattagaagcgtcgactttcttgaagcccttaggggtgtagaaacgtaacaaattcttattgttaagtgaatcagagaggcttaattctttgtcgactttcttctgatctttatcaacagtcttctgaactgcctcatcatcatcaatcgtttcgccagttgcgttgtcataaattttgccgctaaggacggtgtatttagacgtgacgaaatcgcgatttctaaacgcaacggtactatcgtgttgtttagagaagaggtcggtcccaaactgaatataacgtttgcttgaaatccctagtaagtgcagaatcgttggtaggacgtcaatttcaccgccataagtcgattcgactttaccactcttgattcctggaatattgatcatgaatggcacacgttgaagctgggcgctatcaaaggaagtccaatcgtccgcagatttaccgagaataggtgccaaggtcgagttttcactgttggataagccgtagtggtcaccatagagtacgatcatcgaattctttaataaaccagccttttgcaagtaggtatagaattctttgacggattgatcgaggtagtgggcggtctggaagtaaccgttaatggcggaatcactagtatccgttgtcttaaacgtcgtgtcttccttatcaagtgtgaatgggaagtggttcgttaccgtgatgtatttgacgtagaacggttgttgtagccgttcaagatactgaactgaattcttaaataacagcttatcctttagaccatatccagttgatttatcaccagtcgtatcgaaataactggcatcaaagaaatattggtaccccatattcttatacgtgttatttcgattccagaaactggccacgttaccgtggaagacggcggaggaataattggcccgttggtttagaatcgcgggagcggcctggaacgtattatctgagcctaattgggagaacaatgatccagttgagagcccgtaagtactagtttcaagcatattttcggcatcagaagttttcccttgaccaacttggtggaaaaagttcttaaaactgtaagttgagttgctatgatacagtttatttaagaacggcgtaacttccttaccgttgactttctgatcaataagaaattgttgaaaactttctagatgaatcacaatgacgttgcgacccttcgccagaccgtacatcttagcgtttggcgcggcatagtgtgattcagtataatctttaacggtatctaattctgatttctttgcgctggcgcgttgatgattggtctgttcatccttgataccatcatagactgtaaaagcatctataccaagatatttgacgatataagtgcggtcaaacgttctggttagtagttgtggtcggttggattctgctaaggtcaagttaagaccgaaacctgcaatcgcggcagaggtgtacgcaaaggccgtgtgtttcttaattggtcgtgtgtcttgctcaatccgatgaagaatgaccaaggccagaatgacaataatatccgcccagtaaagaacatcgccccaactcgctagggctaacgatgagccggtaagtccctgactgaccttggacacgccggtaatcgtactaacagtcatgaaatccgtgaattcacgatggtagataacgttggcatacagtaaaatggtgtcgagtgcatcaatgaatagcaaaatatagtaatatacaccggttttacgaatgtagaacgccagactaaacagaaagaccgtcgttgcaatcgggttcacgagcatcaggaatgcctggagtggatcggcaacgcctagtgaaaattcggttaagtacgcatagatcgttttggcccagaataagaagactagtagccaaaaaaatccaattcgcgtgttaacgtattggcgaaatttggtaaacatcgataaagacctcatttttaacaaatttggatatgactcgataaccagtcatcaaatcattttaacataacatcggaactcgtaatcgctaacaattttaagaatgcgttaatttcgtttcgagttagtttgacgataaccggtgaaacgcgtattctcaaagtatttcagaagaacgggtgataacgtgatgcagataaaaatgagtaaccaggttgattcatcagtttatgcggatgctattgcaattcgtcgggcagtctttgtgcaggaacagcatatcgatgaaactttggaaattgatacggtcactccagcgacgtggcactacgtcttgtatgatgatcaaaagcaggcggtggccacagcgcgagtgacacctagcgaccaatggacgggacatgttcaacgagttgccacgttgaaagcggcgcgagggcagggctatgcacggcaattgcttcaacggattgcagcggatgggctgagccgtggttggcgacagttggtactaggcgctcaagtcactgcacaagggttttatacacaattagggtatcagccacaagggcgcccgtttatggaggcgggtttgcgacatcagacgatgatattggcattatcgtaagcatattggcgtaactttcagttggttaggttgttgattcgagtcatattccagaataaaggtgccttcaacttaaggcttagctttgtggctgtttttagcgagacaatgtaaatggaatttccggtagacttctaggcatagttctagaggccttttttgctaaacgattagttcggatagttcgcaaataaaagttttgattcgtagtaaactagttggttgcagtattgtacatatggagctgattagcgtgaatcactaactggtggccgaccctgacaatcatacgcgactgtgagggtgtgttgggttgtgagaatgacaaagacaaagctttttttgaatgggggaggagcatatgcgaagaaagctagttgggtatatgctaagcatgttgacggtaatattagcgctatttatgctggggagtactgcacatgctaaagaaatcagtgttacgggtttaacggctggcaatgccatcgtacttgatgcgaatggcaagcccgttactgacacaagtacgttgaatgataaggctggctaccaattaacgtatcattggagtattccagattctgaagtgattaaggccggtgatacagcaaccgttgagattccaacgtacgtcagtatcgatcatgatgttgtgatgccgttaacagattctgccgggcaaaccttgggcacgtttacgtatacgaaaggtgccagtactgggacgatcacgtttacggatgcgttgggtacactcaatagtcgggctggcacactgagcatgaatgcgaagggcaatgcgacggcgacggaaggatcagccgaaattgctaaaagtggcttggttgtttcgtcggaaagtgatggtgcgccaacggtattggggtggcacattaccgtgacaccgggcaataactcgacggttgtagttacagatacgctagggcccaatcagacattcattccagattcggttgcggcacaggccgtgcaaattatcaatggtatccaagtgccacagcaaccgttaacaccgactgttgcaactaatggtaacgtgattacttttacgtttaacaacattcattcgccgtttgtgattacttataacactaaggttgagaattttaatccggctgacacagctaaatggcataatacggctgcactggacggactaggcgttgatgcgacggccgatattacctatggtggcaatggaacagcagggatgacctataccatcgaattaacgaagcatgatgcggcaaccaagtccgtgttggctggagccgtttatgaattgcaagatagtacgggcaaggtaatccaaactgggttgacgactgattcgcagggacaattgattgtcaaaaatctacgtgctggtgattatcagttcgttgaaaccaaggctccgcttgggtatgaacttaataccaccccagtaaaatttactctcggcggtattaagccagaggttgcttttcaggtaagtcaggatgatgtcaagcaaccagttgtgccgacaactggtgatgtcacgttaaccaagactgatgccacgaccaaggcggcattggctggggccgtttatgaattgcaagatgccactggcaaagtgctcaagatgggattaacgacggataccactggtcaacttaccgtatctggtctgaccgcgggcaattatcaatttgttgaaactaaagcgcctagtggttatcagcttaatgcggcaccgttatcatttacaatcaagccgaatcaaacggcagtggtaacggtagcagcaactgatgaaccggtcactgaaccaggaacaactgaaccaggcaaaccaggtgaaccagggacgactgaaccaagccaaccaggtgaaccagggacgactgaaccaagccaaccaggtgaaccagggacgactgaaccaagccaaccaggtgaaccagggacgactgaaccaagtaaaccaggtgaaccaggaacaactgaaccaagtaaaccgggtgaaccaggaacgactgaaccaagccaaccaggcaaaccaggcgaaccaggaacgactgagccaggtaaccctggaaccacggggccaaccgcgccacaaccggaacgaccagctgtacccggtccaagccaacccgctgcacctaaaccgggacaatctggattaggtcaaccggcattaccaggactgatcaagcaaccaagcacgggtgtcaatggtgctggtggcactgtgggtaatggtgtgacaactggtatgaacggctttggaacgccaactggtagtgaccaaagcacatcagctggctataaccacggaactttgccgcaaaccagagagaagcagtcgccgatttgggtgatttttgccgggcttttgggcttgttaattgccgcggtgggaatcggttatcgccgtcgtgcttgaagacgcatgaattgatttattaaagtatcatgtagggattgatgatgccccagaaattttatggtttctggggcattgttttggttatgtgtagagctaacattgtttacggggtcagttcagaatttcaatcaataaatttgaatcatcgtgtgagttacgattaagcaatatggtctagctagctgatgtggagattgttagctgtgtggtggcacacgcaaaatctttggcagtttgcgacgattcaatttagtattgtaaaaaagttgcgtttccagatttgacgtctggaaacgcaactttttttactcaaagattaggctaaccaattgctagcgtttggtagatgatgggcgcaagtgctgccaaagcgtggctatagctggtggttcattagcccaacgtgcccaccctgaaaatcccactggaacgatgaggttacttatcgtaatcccaatgagactcatgagtgtaagcccctttaagattggtgcggtcgtcaaaagcagtggcagtaagtaggtcaattcaatcattgttaccgggcaaacaaaccgtccactagtataaaagtgttgctgcagttgagtgggttccaagtgtcgtaaccaactttgacggtaactggttgcggtggtaatcattagccagtgcagtgtcaacaacatcaagccaccaagcaagacactgctactgagcggcccggtttgcaaccagcgtgttaatattaactgggtccaaccccaactagttaacgtcacgccagttaagcacgcggtcattaacagactgaaggtcaatgaacgcaggccgaaccataaaacaactatgccgatgattaatccgagtgtgagccatctcagtgcgtgggtcgcaatcagggtatgctgatagtgctgttgctgtgttaccccggttgttaggattttggcgtgcgctaagggcgtggcgagtaggctgtcgtgggtgactgcctgaagtcgttgcagggtcctgcgactagccgcactagccggcgctgatttcaaagtgaccgttagctgtgtcatgcttaaatcactactaatattagtaaaaagactgttttgataggcctgattagtagccgcgttagcaggcaggtaaaaactccggccaacttgactagcggctaaatcatgtagataggtcttcgtatttttcagtgaagcgagtaaggtggttaagggttgaacggtctgcttcaatgattggttgacgtggtgaacacgctgatcaacgtgtccagcttcggttgcgaccgtagtttgggccgttaccacgtgatttagtgcggttgtcatgcggtcagtcaggtgatctaacttggtgacctgctgattgactttggttaaatcgggttcagcctcagctgatgtcgttagcgtcgtgtcaatagcctgtaattgccgttgcacttgatcattcagttcagccaaatcattgatgcggtcggacaactggtcgaccgacttggtatggcgactagtcgctgcttgttccagactttgttggtcagtcgtgagttggctcttgagtttcgccatactcgtcagtttaccagccaaatcaatgttgatagtcgcaagttgctggttaacgtagaaattacttagtggttggccggtgggctgggtcactgagatgacttgagccacatttggtacggcccgcagtttagtcgtcaggtgatcgattgtttgtaatgattgctgctgcgttaaattctgcggtgctcgtagtgtaattgtgattggcgccgtggcaccggtaccgaagtgagcttggactaattgctgacctaattcagcattactaagctgattttggcgccagggtcgtaagttgtcatcggcaaactggccgttagcaagaatgaggccggggagtagtaacagtgcgacggccaagctcccaagcgctggctgccagtagccgaacttgctcaattggccccatagattgcgtggacgggtcggccaagccgttgttcctggccaaaataaattatcaccgagccaagcggtaaaggcgtaattgagcggcggtaccgccagtaaggtgattccaagcgctacagtaatggcccaagcagcggctaatgagatgaaggcagtccagtgtaaagtgatggttatgagtattaatgggataaaaacaagtgcccactgtcgatattgaagtgtcagaattttgagactgacagtggtcggtgcggttggtgcgctcgattgccaatacgcgtacataaagtgccatgtcaatagactagtcagtattaaactgattagaccagcaaggctcagcgcattagccgtcagtggccaatgccaagctaaacgcgcgttagtgataaagctaatcgttgtgatcagagtgaccacttgacacagtaagttcagtaatggcactaacagtgagcggaagatgaggccgagaatgattaaactgagcagactaccgacaagcatgctaatcagcaagttgcgacgttgttgttgcacgtgttgttggtagatcaagtccgtactggcgacactcgtattgaggtcggcgattgcaatcgcattattaagttgatttgcaatcacagataggtcagcccgggatgtctgaacggcgacaagggctaattcggtggaaccatcattggaacgtaataagtgccagtcattagtcataccggttggcgttcgaagctggttaatgccataatcatcggctcggcgattaagtttggctagggtcgtggagatttgttggcgttgctgtttggataatttaccatttgaattgttgaagactaacgttaaggactggctgttggttaacccgtgaccccattgttgttgatatttaggactcgttgttgcatcttgtggcattgcggtttgttcattcacaaacgtggtaatgttcggtaaaatcagaatacttgcaaacaccacgattccccagaaaaataagaacaaccactttggttttaataattttcgcattcgtcttgacgcccccacatcaattactttattttgacttaatcttaccatatcaggtgttagagaagcagtttggtcgtcagtttgaaaagttaattacagtaattacttgtgagttatggtatcctaaaacgctgtgggaggtgctgattttgaaaacagatcgatttcaggcgttcagtgatggtatttttgccattttaattacaattttagtcttagaatttcacattcctgattaccaaccgggacatttactggcggcactattagcgcaatggccgttgatcttgtcgtatgtcttttcgtatttctacgttggcacgctgtggttatttcatcatgattatttcaacatgctacaacgaattgatcgcaacgttaatatgctaaacttattaatgctctttagtatcaccttattggattacccgatgtcattagtggcagatgcgttgacaactggtaatcgacaggatatgcaaacggcatttatcgtttatgatttggttgccctgtttatttcggcgacattttatttcatgtacgcttatctgcatcatcaccaggatctaaagaagccgggaatctcaatggctttttataccgcaattaagtttgatccggttcgaagtgtcacgatttatggcttagccatcgtggcaacgttttggtcggtatggttaggtgcaatcttactagcaggtggcatcatttttcactttttggcctacttacggatgagtcgccagctagaacaggcgaagggagggacggcataatggattattcaagtttattaggacctgatcgttatgatctcgccgtgacgttagccaagcagtatcatcttgaccccagccaggtcttgttcggctatttgcaagtggttagtcaagttacgggtggtccgaatgcagcgcaagctgatttacatgagccccaagtacgagcagcaatcaatcaggaatttgatcattttttgaagcagcgtcattaattaaaaatcacgatgtgagttcagtctcaacatcgtgattttttagtttcaatcggcaggaaagaggtacggtgttcgccaggttgttgccatttcaggtgttagtgtcagtcgttgttcgtgaccagtcgtgcgtggaataaagcggtaagtacgagtcgctaacgtgatcaaacaacgatagtgcgtgtagttgtggctgatgagatggcgacggtcggcgtggtatggcaagcttacttcttgtaaccagcggaataaagtggtcggcacttgttgcggtgctagctgcggtgttcccagtcgtcgaagtgccatgtgaatgaaacgatcagtgggaatcggcccgctcggtaatggttgcttagtctgaatcacgtgctgagcagcctgacgagtggcagttgtaatctggttgccagatactgctaaataacgatttagtcggcgctgatggtcgcttaggactggtgtattggtcaggacgccggctggattcggttgcgccgtcagtgggccaccagtgggttcgatgacggcactggtgtgtgcatcactgagataccagtgaaagggatagacttcaccagtgtcatcaccccaggacgcaccgaccaggttaacacttggcagatcggcgatcacggctgcgactgattggtgttcacctaaagcccagttgatgaaggcttggggtgttaaattaatttggttgacttgtggttgagtggcgtattcaacggcgtggggcaagtacagttcagcacacatcaaaccagcttcgttaatgccgtcagccatcaaacaagccttaaagtggtcaggtagccgaccaccaccgagaatggcatactgcgtcatacgcgtcgtcgctaacccagttggccacggataacggcgcggcaaaaaaattggccgccaaggtgtcgttgttggaaagtccatggtgcgggcgaagtagcggtgattgtcagtatcaagataagttaagctggtacacatggcgcggcctcctttgaattaggttcattatacgtcaaaataggcgacagctaaatgactgtttaattaacgatggtaacggttactttttttgatgatctgcgtgtgcaaaacagctggcagtgcaatcagtgacagattaatttatggtcggatggaactcattattttctaatctttacaaacgtgctataatgaggtttcaataactatcaaagcgaggtcttcatagtgagtggatataacgtcgcgattgtcggtgcaactggtgcagttggcgcgcggatgatcaaaatggtggaacagacgagtttacctgtcaactcagttaaacttttggcatcaagccgttcagccggtaaacaattacagttcaatggtcaagccttaactgttgaagagaccgttcctgaatcattcgaaggaattgatttagccctcttctcagcgggtggctcagtatctaagaagttcgcccctgaagcagtcaaacggggtgccgtagttgttgataatacgagtgctttccggatggacccaaagattccgttagttgttcctgaagttaaccctgaagcattgaagcttcatcatggaatcgtggctaacccgaactgctcaaccatccaaatggtcgttgctttggaaccagtgcgcaaggcatttggtttgaagcgggtcattgtttcaacctatcaagccgttggtggtgctggtaaccgggccttgaaggaattgcatgatgagacggaagcctacttaaaaggtgaagagatggaagctcatatcttacctgttgcgggcgacaaaaagcattatccaattgccttcaatgccttaccacaaattgacgtgtttgaagaagatggctacacccatgaagaatggaagatgatccatgaaaccaaaaagattatgtgtggcggcgacatggacagtaaggatatcaaagtaacggcaacttgtgtgcggattccggtgccagtgagtcactccgaatcagtttactttgaagttgaagatcctaaggcaaccgtcaagggcattcaagatgctttggcagctgcaccaggcgtggtcttacaagacgaccctgataaccaaatttatccgcaagcgcataatgcggaaggttctaaagacacgttcgttggtcgggttcgtcctgaccaagaaacgccacaagccttccacatgtggaacgtttccgacaacctcttaaagggtgctgcttggaactcagttcagattgcggaaaccatggacaagatgggtttattgcacatgcaataaaactaatttgttaagggtaatgaaaagctggttgctagaatattaattctggcgaccagctttttttgatactcacagcaaaattgtgcgtcagaatattcacgtggttatcagacacgcggccaatgatgtctgtaacgccggatcaagttgtgattgcaggcatcatttgggggttcaagcgagcagttattccaagccagaatctggcgaaggagtggtcctatcagaccgcgacagaggcggaacatgaggatatccacttcgttcccggtacgactgaagtgcgaccggatctagaccgggaatatgaccggcacttgaaagcgtctggttagcttgaggaacttgcccactttgcgaacgtcaaggactaaagtttacgtcgtcggtagttcacggaaatgataccccaattgaaaacgcgccagctcaatgaagtttcaagctgacgcgtttttatattttaatgattttcgctgagatatatcatagaattccggtagtcttaacgcatcgtcgttcaattaacgacgctttgaaaatcaagttgcgggttgcttggtgaagccatttgggtcgtgaaggtcagttcgataagttaaacgcatgtcaagcaatcaactgcaagacttgctgtacgagcgccgtcgggaccggctttgtcagtggcagattcaggcgcttttgcccggttggatagcccgcggacttagcagcggctagtgtggcgtcatccaaatcagctgagatgctcaggctgacgtgggctttgtaagcggcgatactgacatagtgcttgtcacgttcgtaaaacggcaagttccatttaattctagccttaaaatccggcagttcagtggtaatcagctgcacgagattattgaggattggttgggccgcttcggcaacctgattaatgtaggccgtcgtatcagtcacttggggacgattaggcatgagtaaaagcttcctttactttcgaaatgaattgcgtcgtagcaaccaaatggttagggcacatagtgcaacggcgatgaataccgtaatctcccaaccgaatggattcttcatgaacggtaagtcgacgttttgcccgaaaaaaccgaagacaatgttgggcattgtcaggacgatggagaaaatcgtcagcacccacatcgtgttgttcaaactgttgtctagaatgttcgagtaggcgttcgacacccggccgatgatgtctgaggcaatgttggccatttccaatccttgttgtgcctcgacaataatatcgtcgagccgttctaattgggccgccgagaatttgaccggtacaaaccgtttgagtgactgcaacatgtcgttattacttttaagggacgtgaggaaatagactagcgttgtttctaagtccatcaattgaataatgactgaacgctgaatttgctttttcatcttcatctgaatgtcttggcgttgtttattgatcttgttgatggccgaaaaatattgccgtgatagcttgtacaagacgttaaagatatggtcgtatggatgcaggacatcttcccaatcggcatcgatttcgtctgccaacatatcctcaacgaatattgtgttatcggtcgtaaaagtcagtagggtgtggtcaatcaacatgaaactgacttgggcggtataagtaccttcctcaacgtcttctgtgaccacgtcaaaaataatggtcgtgatggcacttttggcgtcatattccaaccggcctcgttcgtgttgatcggttgcgtagcctaacatttcgtcggtaacgtgttcctcacttacgagttgatgataatcattttcagtgtaattattaacagcgacccagcgaaaatcgtcgcttagttcatggacttttatcattgtttttacttccagcgttttgagatatcttcaatttaacatgagttgcgagacaacgcaaaggaagttttaaggccacctaattatttaacagttgttctacttaacttttcacaccataactggtgactgcgactgaaaagcgctaacaataaatcataactgataatcagtaaaatgactgaaacgacgacaaggtagacatccaggcggttaagggtggcactaggaacgttgcctagacgattgaataaccataaatccaagaataaaagtggcaggccgattaggtagagcccactgtaatggataagcagttgccagagattggcctggtgaccactgatggttacgatctgactattgagcaggcgaccaccaatggttttaccatgccaacaccaggcggacccaatgaagaagaggatgatatcggccaggtatagccagcgaaaatcatgtggtaatggccaattaaaatgtttgactaagacgaagtagacggtgtcaaaggcggcaattgcgagccaatcgatgaccaacgccccaatgcggcgccaattgatggggtgttcctgccaattcaaccgggtactgtggtcgcgattgcgccactgtttaggaatcagatgtagacacccagcaccgacaatcccaccaagtgtgttcatcattaaatcgtcgacatcgaacatccggtaggctcgtgagtagtagccgtataatccggttaactgcgtggtttcgaagaacaatgaaatcgagaagctcgtcagggtgatcaaccagagcggccagcggtgccgccactttaagtaggcaccaatcggcataaataatagaatattgaagaacggctggaagaacgtgtcagatttgaaggcggctaaccaagtactggggtccccgagttcaaacggcgtgagtgccttcaactgggtgagaaagtagaagggttgtaaattatactcagcagttgttaggctagccacggatgagcgagtcgggagtggcagaataattagtaagtaggctgctgccaagtaccaaataaacgaataggtactgatcaagttacgctcactcagtgtttgacgtgttcggagctggatagtcaggataatcatggcgagtagtaaggtcatgatgggtaaagctaagataacgatgtgcacgggttccagcaacgtactgacaatgtgactggaaagtgcgagttgataaagttttgtaatgagttcgtgcatggccggtccccccttttttgggaatagcgctgttctttaactaatgttgactatatcatggtataaagaaattgtgacgattaatataaataaataagtaaattgttagactttcgccgtgactgctagcgtattgtcgcgaatgaccgtttcgaccatacttgcttatctaaaaaaaatatgattgaataagcataaattatgagagggtgatgaggatatgctaatggatgggcatacccacacggaactatgtccgcatgggagtggtgaagcaacggaaaaaatgattcaacgggcgatacagctaggttttcagcggtattgtatcacggagcacgcaccgttaccaccggcatttcgtgaccagtatgaagggacgccggccggttatactgaggcgtcgttgcgtgaggaccaagtagccgattatttggcactggctaacggactgaagaccaaatatgccgggcaaatcgagatctcagtgggttttgaagttgatttcttaccagagcatgttgcttggacgcgtgattttctgaatacctatggtcctcggacgcaggaaagtattttgtcagtccatttcatgcgggggttacggcagcatttctggtgtgttgacatgtcaacggatgattttgcagccggttttgggcagtggcttaagacgccccaacgtgtttttgaacagtattatcagacggtcttggcatcagtacaagcagatctgggcccttacgcaccacaacggatcggccacatgagtctcgtccgcaaatatcaggattactttggcttgactgaacccttggatgtccataatcttcaattagtagatcagacattggcgttagtgaagcagcaacggcggcagttagatttgaatttggctggtctctacaaaccgtattgtaatgatttttatcccggtgaacagattctacaacgcgctcaaaagcttgacattccgctggtttatggctctgatgcccacgacatagccagtgtggggcgtggctatcatcttataaaaaaattaattgagggttgacagccgtcagtttagtgattacaatgaattataaattaaacgactaatcaaattttaataaacggttgtgattagaacaagtaattaagtcttcctcatccagagagcccgggtagctgagaaccggacagacaggcttaacgaacacacatctatgaactgctaaggtgaaccagtctcattagccttagccgaattggtttcgttatccaagttgacttgatcaacatgaggtctgccgtgcgaacggtagatgaaataaggtggaaccacgcgtaaacgtccttttagcaaattgctaagggggcgttttttagtttcaccgatccatgcggtaagtttgcgtgacggaatcgcaagtcgctccggttagcatgtaagcaattgattaatcacgttgataagtaacgatatgaattaaactgattagttttaaaaataacgacgttttaggaggcgtaaattatgttgaaacacttattaccactaggaacccgggatgaatttggtcggcgggcacgtaccaaacaacacttgatcgcggtgatccaagcccattttaaacaacgcgggctcgcgccaattgcaacgccgttattagaaaacgaagcggtgtttgatccatatcagatgggtaactaccaactataccgcttatttggcaacgatggtcgcaccttggtcttacggccggacatgaccttaccagttgctcgcttcattagcgcgacgaatgtccccttaccgcaaaagtttggctatgtcggcgatatctttcgagtaagccgtcaattatcaggttcatataaccaaatcacacaagcgggagtcgaattagtcggttacgcatcgctgaaagccgaatttgaatgtttaacgattgccaaccagctttcaagtgagctgattgccgatgctgttgaaatcgaattaggagatgcccaatttgcacaacgggtcgtggccagcttgactggtgacgaaggcgaacaacaagccattttaaccgcactgttcgataagcaagtaccacgctacacgaagttgattgccaagtaccgcgcacagcctttatacgattttctcaaagcatggccgcgtttgttcgggcgtccagaacgtatcttcaaagaattagcggcagcaccactacctgaaacagtccaaccaagtctgaaacggcttcaaacggtggtggcctggatgcaacaaacgatgccggagcaggtcatctcggtggatttgagtagccaagcaccacaaaaatactataccggcctgacttttcggggttattcacaagcgggggctggctacctgttcagcggcggccgttacgacaaactgttaacgaactttcaagctgaagcagaaccggctgtgggaatggggttaaacgttgacttgttaacgactttagccaccgaccaacagaccgcttatgctgaacaattgatttactttgagcctgaacagtggtcacaagcggaggcatacttagcgaaacaaccgcacgccattttgagtttggcggatgacttagcaggtgcgcgcatcgaagcacaacgtttgaatgcccaactgattgatttaactggaggtatgaccaatgactgaaccacgtttaaagattgccttgactaagggccgcgtcgaacaacaagtcctgccgttgctggaagaagctggactggattgttcgcaagtccgcaacaagcaacggcggttgatttttgattctgagacgcaaccatatgagtttattttagcgaaagggccggacgtgacgaccttcctcgaacggggtgctgctgatatcggcatcgttggtagcgatattttgactgaacacgagagtacccaatatgaactgttagacttgggggttggtaagtgccaatttgtgctagcatccacggccgactttgatcccgttgcaccacgacgcaaaatcatcggcaccaagtacccattgattacccaacggtattttgatcgcttgggccaagatgttgaaattattaagattgaaggctcggttgaattagcaccactgactggcttagccgacgccatcgtagatatcaccgagacggggaccacgattcgtgagaaccatttacaaatttatgactatttacaaccagtctcgacccgcctagtggtcaaccggttagccttaaaacagcaacaagccgccatctttgatttagttgatcggttggccacagttgttgatacgaataatccaaaggagtttgtctaatgaaaattattaatgaagatttagctagtttaaaacgcttagttcaaacgaagacccaacaattgactgacttaaaggttgaatcagcggttcgcgaaattattgccaatgtgattaaaaacggggatgccgccgtcaaggattacgaaacccaattcgataaggtcaccttgaccgactttaagttgtcacaaactgttattgatgatgcttataacaatctggacccgcaagtgaaggacgccttgttgttagctaaacgcaatatcacgagttttcacgaaaaggaaaaggcgactggctttattgatgctgaacagcctggcgttctacgagggcagaagttaatgccgcttaatcgggttggcttatacgttccaggtggcacggcagcctatccatcgactttactgatgagtgccttgcccgctaagattgccggcgttaatgaagtcattatggtgacgccaccacaagtcgatgacatcaatccagccgttcttgctgcagccaaaatcgctggcgtcgacgccatctatcaagtgggaggcgctcaagcaattgctgcgttagcttatgggactgagtcgattccagcggtcgacaagattattggtcctgggaacatttttgtggcgactgctaagaagcaggtctttggtcaggtggcgatcgacatggtggccggcccgtcagaaattggtattttagcggatgattcagctgatcctcggcaattagcggctgacttattgagtcaagcagaacatgaccgtcgagcccggccaatcctaattacggatagtgccgacttagcgcaggccgtcagtgacaacgtgacgtcacagttgaaagttttgccacgagaagcgatcgctaccgacgctgttaacgaaaaaggcttcattgccgttgtcgcaaaggttgaagaaatgtttgacttgatgaatacggtggcaccagaacacttggaagtgcaattgaagaatccaactcagtacttgaatttaatcaaaaatgccgggtcggtcttcttaggacgctacgcctctgaaccactcggtgactacgttgctggtccgaaccacatcttaccaacgagtggcacggcccgtttctcatcaccacttggcgtctatgatttcgttaagcgaacgtcctttatccaatacactaaggacgctttggctaaggaagctccggcgattaccacgttggcacgggtcgaaggtctggaaggccatgctcgtgcgattgagagtcgttttgacacctattacgattagggcgtaattagtagttgatactgattgtgattacagccggtagtcgttttagcagatgaggaggaaatgaacatgcgacaagcaacgattaaacgtgaaacgaaagaaacccagattgaaatcagtttgaatttagacgaacagagcggtatcgaaatcgataccgggataggctttttgaaccacatgttgaacttatttgcgaagcacgggcgcttcgggttggtcgtgaagtgtcacggcgacctcgacgttgacccgcaccacactactgaagatacgggaatcgtgcttggcgaatgctttaagcaggcgttgggtgataagcagggaattgaacggtacgggacagaatttgtgccaatggatgagactttaggtcaggtcagtgtcgacctaagtggacggtcatacttagtttttgatgccgagctcacgaatccgcggctcggtggcttagatacggagacagtcgaagatttcttccaagccgtggcctttgctgctgaaatgaatttgcacgcacgcatcctgtacggccgtaacactcaccacaaagttgaaagtttgttcaaagcgtttgggcgggcaatgcgcggggctgtcacgattaatccagatattcagggggtcaactctacgaaaggcgtgatttaaatgtttgcaatcgtcgattatgatacgggtaatacccgtaatttgaagaaagcttttgactacctgcaagtgtcaaccatcttaacggctgacccgcaacaattagcggccgctgacgcagttattttacccggtgtgggagctttcgcagctgcaatggccgctttaaaagaacgccagttagtcggcgtgttacaagcattggcgcggagtggcaaacccgttctcggtatttgcttaggcatgcagctcttgtttgaaagtagttccgagtacggcgagcatgctgggctaggcttgttaagcggccgggttagcgctttgccaacggacttgaatgtcaaagtcccacagatggggtggaatcagaacgagcttcggcgtcctgatagtccctttgccagtattgacgcggcctatacttacttcgttcattcgtactatgcggtatgtccggcaactgaaatcgtggcgacagttcaacacggcgtccaggttccaagtattgttcagcatcaaaatgtgattgggatgcagtttcacccggagaagagtggtcgagtcggattacaacaactagcagcttttaaggaaatggtgagtgcaaatgatttttccagcaattgatttacgagccggtcagagtgtccggctctaccaaggtgattttaaacaggcgacattgattaatcctgatcctgtcgttcaagcccaacaaattaacgcagcgggcttgcagcaattacacatggtcgatttggacggtgccaagtcagggcgcccagaaaacttcgcgacaatcacggcgatccggcaagcatttgccgggacgatcgagctcggtggaggtattcgaacctacgagctggcgactcgttatctcgaattaggaatcgatcgcttaatcttggggtcagttgcgttgactgatccacgactggtcaaacgactgttaagtgagtttggtggtgagcgaattgtgattgggttagacggaaccaatggttatgtggcaattaaaggctggttggagcagtcacagaccaagatgagtacattaatgaagacaatgactacgagtggtgccaagcactttatcgtgaccgatgtcgcccgtgatggcacgatgcaaggccctaaccttgcgttataccaagaactacaagcacaggtgcccacggccaacctgattgccagcggtggcgttcggaatttgaccgatgttcaagtgttacaagccagtgggttcaaggatgttattattggcaaggcgttagctgaaggcggtgtgacactggccgaattagcgggggtgactgaatgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaagtctcagctcaggtcttcatgccactgacgattggtggcggaattacaagcgttgctgatatgcaacgaatcttacgtgcgggtgctgataagacggctattaattcggctgcagttgccaaccctgaactgattcgtgccggtgctgaaaaatttggcaaccagtgcattgttgttgcgattgacgcggcgtgggatgcggcagctggtcaatatcgtgtctatacacatgggggtcagcaagcgaccgacctcgatgcagtggcgtgggccaagcaagcggtcgccttaggggctggcgagttattggtcactagcatggatcgcgatggcactaaggcggggtttgataccaagttatatcaggccctgggagcagcggtcaatgtgccaatcattgccagcggcggtgcgggtaacttacaagactttgtggatgtttttagcacaaccccggttgatggtgcattggcggcttccgtctttcactttggcgagttaacgattgcagatgtcaaagcgacattaagaaaacaaggagtggtcgtaagatgaaaccagactttgaaaagggtgacggcttactgacaacggtcgtcaccgacgcggatacgaaggatgtcttaatggtcgcgtggatgaacgcggaaagctatcaacggacattggcgtcgggccagacgtggttttggtcacggtctcggcaagaactttggcacaaaggcgctacgagcggcaatttacaagatgtcgttagtatgacgctggattgcgatcaagatacactattggtcgcagttcatccgcatggtcctgcttgtcatacgggacatacgagttgtttctttaacccggttgaactagaaccgggcgcctaaggattgatgacgatagccgcatgagttgggagttagatggctgattggttggaaaatgcggtcccaacggtcgataagcaggattgtttttaacccgtattaaattgatgaatatattatagaagaaagtggtgtcgaatatgcaaaatatggaagaattatacgaactgatcaaacagcggaaggcaacgcctaagaagggctcctacacagattatttatttactaagggactggataagattttaaaaaaggttggtgaggaatcaaccgaagttattgtggcggccaaaaatcccggtgacgacgaattaacctatgagacagccgacttgttgtatcacgttttagtgttattggtcgaacgtggtgttagttttgaccagattaagcaagaattggctaaacgtgaaggtaagatgagtgactataaggatcggcccgaaattaagaacctataggaggtagccgaatgaaagctagtattgaacagttagaaccctatgtgcccgaaaagccgttggcgaccctccaagctgagttaggattgacagaattagtccggttatcagctaacgagaacccgtatggcacctcgccaaaagtggcgaccgctgtgaagaattgggacttcacccagagtaatcgttatcccgatgccgacgcacagaagttacgacaagcagtggcccagcaacagggaatcgacccgaatagcatcgtttttagtgtgggtcttgatgagatgatcgtgatgttatcacggacgttcttagccaccaacgaccaggtgctagtgtccgcaccgacgttttcagaatatggactacatgctgagatcgagggggggcaattaatcagtgtgccaacgttgcctaatgaccatgtgaacttcgaaggcttaatgaaggccattacgccccacgtgaagatggtttggctgtgcaatccgaacaatccgacgggcaccgtggaatcattagcggcaattgaagcgttcgtccagcaagtacccccggagacgatggtcctgattgatgaagcctacattgattttacaccgggcgcggctcaagtaacggccatgcagttaccagccaagtacccgaatgtagtggtcatgcggacattctccaaagcatatgggttagctaactttcgaatcgggtacgccgtttttaataccaaatatgccgcaacgatgcaaactattcggcttccatacaatgtgaattccttggctcaagtggcagccctggcggcaatcgatgatcctaattttgtgaaacaaacggtccaaaaaaatgcgacggaacgtgctaagtggatggcattctttgatgatcagggtgtcacttacgatcaatctggcgcgaacttcattttctttaagtatccgagtgccacgcaactggctgactatttagtgcaccatgggtatctgattcgcactggcttacggccagggtggttacgactaacggtcggaacggctaacgataatcagcaactccaacaattaattcgtgagtttaaggcctagaattggcgcaaagaaacctgagtaattggtttctttttttgttgccctaactgctgaataaattcgaggcagctggtccgcaaggatagttgtcaataacacctgctaaaccattaactcaagtgttgacttcgacgccactctaagcagtaaaattagggtgataaaatacaggagggacaacaatgtcagaattagataaattagcagctggggaatggtatcaatttaaagatgctgaggtggccgctcaaaaagcgcgggctgccaagttatgtcaagagttcaatcagatcgatgcaacaaatccagatgcgcaaactgccaagattcaagagattcttggtagttacggttgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacggctagtggtcgacgtgctagcttggcccagggtcatccagtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataagaaaggtcgcaattggctagctttttgggcacttattttactcattggcatgatgagtcgtaaatacgacgaaaataaggtttatttttgaaaattagtccgcgtaagcggcaccaattatttttacaggtatacttagattaacaaactaatattaagcgaaagaggatgccgtttgttacatttaatcgaacagttgtatggacccttcttcagtgcgactaactggggtaacgtcatcacatctgctaatgactggttaatcattttatcgttagcaattattgagtgtttactatcagttgataatgccgttgtcttagctgctcagacccagagtttagataatttacaagagcgggaaaaatcgttattctatggcttgtggggggcctatatctttcggtttttaattattgggattggcacgtatttgatcagtttttgggagatcaaagtgttaggtgcggcttaccttgggtacttggtgtatcgatactttagtcagccgaaaaatggggccaaggtggcacagaaacccaagcaacaacgacgcttcttcggactaagcaacttctggtcggtcgtcattcagattgaaatgatggatatcattttctcaattgattctgtattggcgtcattggcaatttcggataatccggtgattgttttgattggtgggatgattgggattgcctgcatgcggggcattgccgaggtcattatgcgcttaatgcgcaagattcccgagttggaaaccatggcgtattgcttgattgtcttgattgccatcaaattatttatctcaattcctgccattggttgggatattcccgcaacggcttttggtggtatcgtattagtagcatttattattacgttgctgattcatttttggcgtcggcgccgcaatgaacagtgcgtggaaggaaaggtgcgtaaatgatgaaattaggttggattggtaccggcgtcatgggggcagcgattgtccgtaacctgatgacggccggctatgacgtaacggtttataatcgaacaaaaagtaaggcggatgcgctagttgcggcgggggccacttgggctgatacaccggctgccgtggcagaaacgagtgacgtgattttcaccatggttgggttcccacgggacgtcgaacaagtttattttggtgatcacgggattttcagtggattggccgctggaaaaacggtaattgacatgacgacgagccaacccaagttagccgttaaaattgcgacgtacgcgcgtgaacatgacatgcacgctttggatgcgcccgtgtccggcggtgatattggcgccaaaaatgccactttgacggtgatggtcggtggcgatgccgatacgtacgaggcgatgttaccattatttaatgtgcttggtcacaaggtcaatcattttggggatgctggtactggtcaacatgccaagatggccaatcagatcatgattgcagggacgatgactgggttaactgaaatgttattgtataccaaggcagccggtcttgatccggaaaaagtcttggcaacgttatctagcggtggtgctgacaactggagcatggataattacgtgccccggattctgaaggacgattacacgcccggcttttttgcccgccattttcttaaagatttgcggattgctttgagtgaggcggatgcgatgggacttaatctggttgcgacggcgcaggctaaacgactttatgaagtaatggtcgatgtcaaaggcttgggtgatcaaggaactcagggattgattaatatttattagcgcgtggctgacttgatgaaagtcgctcaaacatcatatatttattgaaataatagttatcaaggcgggaattcagcgagtttaatctttctgaatccccgtcttttattaacatgatacgcattatgcgaggtaatttgtcatgaatcgtgattaaaacatgccagttatgtcagttcaaaagcagccagcttaggcctgctggaaaaagttcgagttagcgtaaaattacttagttgacgcgtcctacgccgacttccaggcatttctgccaattgctggaacgcggtggacacagatttaagccgcagaccacgtcttaaatactggtcttccacgctttaatgccatattggtgaaacgtgctcgggtgagactgaacctcacactcttggcagtactgagcattggccgaaacgccttccagtcgggacagtgttcgaatggcggacatggatgtacccaaccattgatggacttgtcattgctttttataaacgataactttgtcaatcaactgtcagacagaaaatgatattgtgatagtttactattcccaaatcaccatagtaataattaaacgtctcgacaaagtggttaacgccaccctaacgttatgtttaaagttccagtaaaaaatatagtcagcgactaattgtaccaagttaagtggctgttcatttgccatttgagcggcttcccgactggaggggctgggtgacaatgctcagtagccaaattattcttagctggaagtgggttgcttccggcttagaataagactcgtatttgagatgacgcgggttatgcgttagctcaaatcgacgtcggctgcgttccagcaattggcacccagccccggaggtcggcataggacgcgcaccggctgacgaacagtaatttaactggcacgttttaatcacgattcatgctaagtaataactagtacaacgtctagcatggtattttatgaaacgatatctgaaaataaacttggtatactgtcaatcttgatggctagcattttgatgcattaaaaacggattcttcagcgatgtgtggctgaggaatccgtttgatgtttcatggcttaattaaggcctaattgatttagtttaaggttgcggctgctttttgggcagcgacgttgatgatgttccaaggacggtcaaagcctggttggaagaagaagtccgtgtaagctaagtcagcaacagtcagtttagcttgaatagccactgagatggcgttgatgttagcagtaacatcgtacttcgacatgatttgcgcaccaagcacgcgaccatcagttgggtcaaaggttagtttgaaccaaactttggtgttgccagcatcttcagagacaaatttaggccgaatggtatcggtgactaacacggatgccgtcttaacgcccagcttgtcagccgtgccttctttaacaccagtggaagcaaagtggtagtcaaagacggaaagtgcggatgaaccagaaacagcaggcattggtacgttttcgccaagtaagttcttagcggcaatccgaccttgccgacgagcgttagtggctaacgcaatgcggttatccttgccagttggggcaaatgggactaaggtcgagtccccgacggcgtaaatgtcagtgtcactcgtttggaggtggtcgttgatcttgatcaaaccgtgatcatctaagtcgacaacgcctttcaagaagccagttgctggccgaatcccggcggcagttacgaccaggtcagctggatattcgccttgatcggtcactactttggtgacgtggccgtcaacaccttcatacgctttaataccttggccaactgcagcatagatgccgtgatcggccatcgtcttagtcaagatatccgtgaattcttgatcaaggtaaagactaagtaaacgtggtaataggtcgataaccgtgacgtgcatgccagctttggcaaagacttcagccgcctcaattccaatataaccggagccaatgacaaccacattcttaacgctagggtcaacggtcttggcctttaatttgatggcccagtcgcgtccacgcattgcgtagatgttggctaagtcatggccgggtactggtaggtcaaatggtaccgcgccgacacttaggactagtttgtcataagtttcatcacgttcgtcaccagtggcgtggtcaatgacgtgcacactgtgactagcagggtcgaccttactaatttcactatttacaaaaacgtggacgccttgggcttgcatgccagcaggagtggcatagctgacggagttaacgtctttaacggcaccttcgaggtataattgcatcccacatgagaggaatgacagaaaatcacctttttcataccattgaatttcagtatctggttgagcggctaaaataccgcgaaccgtttcataaccaccatgagaagaaccaacgacaataactttcataattgtaaagcctccaaattttagtttagaactgttctaaatagaatataacacgaactaagtttgtcggcaagggcagtttgtaattattctaaattatcagtgaaaaatagctgtgcccgtcgacaccatttagtttagaaatattctagttagaatatagcactaaaataaattgttcacaactaaaacggttacaattagctgcaaaaaaacacccaatcatcaaaaaattgatgactgggtgtcagtattaatagggatggacttaatgattattcaataatatcgaagaaacttagcaacttttctttggtcaattgggctttttcctcatcacgaacatcatacttaatctggccctgatcaaggacaatcaggcgattaccatagcgaagcgcatcgtctaaatggtgggtgatcatcagacacgttaacttttcctccgtgacccgttgattcgtttgtgtcattagttgagcgctggtcttaggatcgagtgcggctgtgtgttcatctagtaacaagagatcagggcgctgctcggtagccattaaaaagctcagagcctggcgctgccccccagataaattttctgttgccgtgttgagccgagctgaaagaccgttgccatccatcgtttccgttaaggcttgaaagtggggcaggtgctttttcaattggcgtaattttaacgtacgtcgcttaccacgttggctggcaagcagtaagttttcggcaacggtcatccggggtgcggtgcccatcttggggtcttggaaaacgcgcgccaggaaagcggtccgcttttcaacggataatcgggtgatgtcctggtcacgtaactggatggtgccactatcaaccggtaactcgccactgatcgtgttgaagagggtcgacttaccagcaccatttgaaccaagtacggtaataaaatcaccatcatagacgtctaagttcaggccccgcaaaattttgacctcattcggggttcccgaattaactttggtcacgatattttttaatgataataatggggcactactgttcgtcataacgggccactcccttctttaaaacgtgattaagatgtagaactttactgaattgcggtaacattaagcagattgccagaattaatgcggataacaggttcatgtcgttggtgttgaagcccagttggaggactaacaggcgcacgaactgatacaaaatactgccgagggtaaccgcaacgagtcgttgattcaacgttaattcaccaaagacaacttcaccgatgatgatcgaggctagcgcaattacgatgattccgattcccatgctgacatcggcataaccgttattttgcgcaattaatgcgccgcccaggccaatgataccgttagagaccatcaatcccatgatggtcatgttatcggtgttaataccaattgaacgtgccatttcacgattgtcaccagtgacaatgaaggcttggccgaggttagtttgcaagaagacaatcagaagcacggtaatgatactgatcactactaggccaacaaagacgctgtcaaaatatttaggcagtgattccaaaaagtgattagaaaaaatattttgtttgcctagcaatgaaacgttggaactgccgcccataatgcgcaaattgattgataagcacgcggtcatcactagaatcccggctaagagaatgggcactttacccttggtataaagtaggccggtgaccaggccggtaatcgcgcccgcaacgaaggctaacagggaagcggtaacggggcccattccatggctaatcgccatgacagcagtggccgcaccgagtggaaacgtcccttcgacggtcatatcaggaaaatcaagaattcgaaatgtcaaaaataatgcgacgcctaaggttgcccacaagaggccttggccgatactcgatacgatcatactcatttgtaaataacccctttcgctttggcttctttaaggacacttgctgggaacttgatgccgagctttttagcttcacttaaattgatggtcatcttacccttagtgatgactttgattgggtagtcgctagttgctttgccctttaaaacttgggctgccatttcaccagttagtttaccaagttgatactggtcaacggataaggttgcgagcccgcccgctttaaccatcgtatcaacggctggaatgactggtaccttagccttatttgtaacggagactagcgttttcatggcacttgcgacgccattatcttgcggcgcataaacggcgtcgacattggcggccatggtttcagccacttgctgcatatcgttggtgttagagatagtatataacttgtatttcacaccttcttgtttacaaatccgtgcaaactttttggcgttatattcaccaccatgatctgaagtggtgtaaataattccgattgttttagcgctgggaacgagcttccgcaacaagtctaagtgggatttcaatggagattcaccagaagtccccgtaatattggcaccgggatgttggtcgcttttaattaggccgctacccgatggatcagtaatacctgctaacataacaggggtttgcttgttagccgcagaagcgagggcctgcgcggcgggggtggcaattccgactgttaacgcggcgttttcgttcatgaatttttggctcatggttttcaagttactttgatcgccctgggcattttgatagtcgattttgaccgtcttgccatcgacataaccatattcctttagaccagcgaccacgccacgatgaatcgcgtcgagtgcggggtgggtctggagttgaagaatgccgaccgtcggcactttctttgtactggtcgtcttcgtggcggtggttttgcctgtcatgacaaaggccactcccagaaagacgatcaaggcactaatgaatgcaatcatacgtttcaatctaatcacctcaaaaaatttcttaagctcgggcaagttcaaagccaataaaaaagggcaaaccagtaagctctggtttgccctttacggaaccgaagcctgctgtgttaaaacccatgcagacttctttgaatatcaaagtgagccggcacagatacaaactgtttgccagattgtatccgtgtggacggcattacaatctgaacggccggctttgccatgaactgttcaagttagtaactgactttgacatgcttggttcctcgctttcgttattgaatgagttcagtataggcaaagtcgaaaaaagtgtcaaggataaatttcaccaaatattaaaatttgtggtgaaaatcttgtgagatgcggatgcttggtcgtcggcatttgttcgttctagtccgacctccggggcggggtgccaatggctggaacgcagccgacgtcgatttaagcccgagcaaaacccgcctggtctcaagcctgtgaggggccacggttgaagccgaacattgtctagtaacggattaatacggttttgacattagtctgttggcgtagcaagcacagaatttagtggtaccgaacacgtttcgggaaaccgctcgaatggctgatgaacgaccaccgagcttagtgcaacttatcggtgcctattttgatactggcactttaaacaaagcgttaggttcattaaagcattctgttgagagattaaatcttactacaccgattcaggattagtgagctatctcaatatcactttcagtctgacagttgattgacaaaataactgtttataaaaagcaacgacgaattcatcaaaagttgagtacatctttgtccgccattcgaatactatcccgactggaagacgttccggcaattggcagaaatgcctgtaagttggcttaggacgaaccagcaaagcatgtttacgctaacttgcacgttttccagcgggcctaagctggctgcttttgattttagttattcagcaagttttgaataagcattcaagtaaaacataacgaaaaaacaataaaatgagttgacaatgaataaaggcggtgttaaattagttttaaattaaaaacagattaagacgttgaagagaagagtaatcgcatcactgatttgcagagagcttcgtaatggtgagagaagtattcaggagtgcggtgaagatgagcttggagtcatgatgcgggtcgtagtggctacgcatgcggtggcaaccgatatattgcggggtttcctagatttttcagggtactcgtcgaggttgtgatcgtgagatggcagcgaacaacggtggtaacgcgaaagctttcgtccgttagtttctaacatattagagactaatggatgggagcttttttttgtttcaatacaggtgagagggagcggttagatgacagtcacagcaaataatggattattagcggcccgtggagaatgggcgaacgcaacgtgtcaagaaagtcatcaggcacaacagattttaattttaaacttgatgccgactaaggtaacaacggagcggcagttcctaaagcgttttgcagccggtaacacagatgtggctgtgacgtttatgtatcccgcgagtcaccatttcaagagcctgccacaagcagtggtcgcggcacattacgtgacgttggctgatattcaagatcagtattttgatggcttgatcgtcactggcgcgccagttgagacgttaccgtttgaagcagtcgattactggaacgaattgttaacaatcattgattggtcacgacagcacgttagccagactttatttgaatgctgggcagcacaagcagggctatacgcacagtttggaatcgcaaagcgtgccgttgctcacaagatattcggtatttatagtgcgactagtactgatgttaagtcaccgctgattagcggactgaatgctggaggcttactaaaaatgccacagtcacggcatacagcactagtgatgccggaacacttacccgctggattgcaggttgtcgctgacaatccgaaggtgggaccgctcgtcttatctgcccccaagctgcacgcggtctatgtgaccggtcatcctgaatacgaacgccgcacacttgccgatgaatatttgcgcgaccgacgtaagcacttgccgattcagttacctgaacattactttgctactgaacaattaacaacagttgattacagttggcaaacttcaagcaatcaactgtatcaaaactggttagcaactttgaatttaacgaaagtaggttattaattatgacaacaacgaatcctgaaaattatcactttgaaacgttacaagtccatgcgggccagacggttgatgaaacgggcgcacgggccgtgccaatctatcaaacgacttcatacgtctttaaggatgccaagcaagctgcgggtcgctttgccctgactgatgccggcaatatttatacacgactgacgaacccaacgacggacgtggtcgacaaacgagtggccgccttggagcacgggacggctggggtaacgctcgcaacgggttctgctgcgataaccgcggcaattttaaacattgcgcaacagggggatgaaattgtggcggccaacaccttgtatggtgggacctatgacctgtttagcgtgacgttaaagaagttgggcatcacaacgcactttgttgatcctgacgaaccggcaaattttgagacggcaattaacgatcatactaaggccttgtacgttgaaagtatcggtaatcctggcattaacttagttgattttgaagccattggaaaaatcgctcatgatcatggcattatttttattgttgataatacctttgggacaccatacctagttcggccacttgaacatggggccgacgtggtcgtacattcagcaactaagtttatcggtggtcacgggacgaccatgggtggcgttattgttgaaggcggccaatttgactggcgtgcgagtggcaagtatccagatttcacaacgccagatccgcaatataacggcctcgtttttgccgatttgggcggggcagcctttacgactaaggtccgggcggaaacgctgcgagataccggtgcaactatcagtccctttaattccttcttgttgttgcaaggtctagaatccttgtcattgcgagtagaacgacacgtgaccaatacacgcaagattgttgccttcttaaaagcacatccaaaagttgcctggatcaattatccagaactggaagatagctcgtaccatgacttagcaactaagtacttcccgaatggggttggttcgatcttcaccctgggcttgactggtggtgaggctgctggtaaggcattaattgaacatctacaactcttttcattgttagcaaacgtcgctgatgctaaatcattaattatccatcccgcttccaccacgcatgcgcaattaaatgaacaggaattgttagcagctggtgtaacgcctgacttgattcgaatttcagtgggggtcgagaacgccgatgatttaattgctgatttggatcaagcattggcacaggtttaataggtcggaatggtcgatgattgaaagtatatgaaacggagggtgcgacaatgacaacgacaattgaagtgggcatgttagggttaggaactgtgggtagtggggtggttgaacggttgacccgctcggctgccaaaattgaacaaacgcagggtattcggttgcacctagcagcagttgccgttaatcatttgaacgcgcctcggactgttcagttaccgattgggacgcgcttgaccgattcattaacgaacgttgtttgtgaccgaaaaatccaactagtcattgaagtcatggggacggtcgcaattgctaaaaaggccattgtggcagcacttaatcagggtaaggctgtcgtgaccgctaataaagacttaattgcaacggcgggacctgaattggctgcgttagccaaaaaacagggctgtgatttattttacgaggctagtgttgcgggggggattccgatcttgcggacattaacagatagttacgtgacggacaatgtgcaggcggtcagcggaatcatcaacgggacggctaattatatgctaagtgcaatggcaaccgggcaatcgtacgaacaagctttagctactgcacaagcagccgggtacgccgaagctgatccgactaatgatgttgcgggcattgatgcggcatacaaattgatgatcctcagtcgctttgcttttgggcaagagttgagcctgccgcagattgcacccacgggaatcacgcatttaagcgcttcggtttgtcgattagcagctgaaaatggctggcagattaaattgctcgcgcagattcagcgacacggatctggtttgtattgtcgtgtggcgccagtggccgtgccggttgatcaacccctgagtcagatcaatggggtccaaaacgctgtagctgttcaaagtgaagccattggtaccagcttgtataccggaccgggtgcgggaagtacggcgacggctaatagtgttctaaatgacgtcttagtagcggccaagcaccttatcaatggttatcgaatgattcgtaaccagaaaagaagtgtctcgttaacggtcactcgatttgaccagttaccacaaacatacttaggcattggtccggtcgcaccagaagccgtgaaatattacgctaatgaagctgatttctcagtaaaaacgattgccgatgattgttatcagattactggattaagtgcggtgaaacgcaaaaagctgcgtgcgaacttgccactgactttgataccaattgccggtacaacggactggaagcaagtgaccgaaaattcaataacatctcccataaatgttgcaatttgaaaaagaatgctcaggtacagtatactgtatctgagcgtctttttttgatgctaagttcccatgggatatccatggctaagtggatgagctaattgaaatgagttagcgagacgtggcagttggttgactgacacgatgaggagtgaaattatgaaaattgcggtggtgaccgaaagttctgctaatttaaaagcgcaggcggtgaaagactaccaaattacggtggtgaacgacccgattatgttcggtaatcatgtttaccacgagaacgtagatatcacgacggatcaattttaccgattactaaaagttgaaaaagaaattccaacgatttctcaaatttcaatgccagagatgcaagtcgtttttgatcagctgcaagcggcgggctatgaccaaattctagttattgggttgagtagtggtatcagtggctggatcaataatttgaagacctatgcgccgtcagttgacggtattgacgtgcgggtgtttgattcacgaactgcttgcgcggggacggcgaacatggtgaagctggctgcggccatggcattggcggactataccttagatgaaattattgcgcaactgacgcgcttgcgggcggctacgacgacggtcttaatcgttaactcgatgcgccatctagttaaaaatggccggatttataacaatagtagtctggccggaacgatggtgttgcgcaataagccgattattatgttcaatgggcatgggaagattcaacttttaggtaaggaacggacgcttaaaaatgcacaacaggctgttcaagatgaatttagtcagtttgtgatgaacagtcaattaccagttcggctggacgtcatcagcgctaatgacgcgcagattgccgaagattgggcgagcgaactacgttatcagtttccagcagtccgggtcaagactggggttatcggtccagttttaggcgtcttgactggagaccatgcgctcggaatgatctggtcattagattggaagccattgttgacgaccctcaatcaggagcaaaaacaataggccgttggggttgcccgtgtgcggtttgctgatgatactgtcgtatacagacagctgggttttaaaaaagttttgcatcgaaggttgacattttactaaaatgatattatggttataacattaaaacttgatgaaaagctataatgctttaaggagtaactgacttgtgatgctcagaaagcgccgttgctgtgaaggtgtgatgacaagtgagtaaaagttaaaggattggcgtgaattttacgagattcactggtagcacccattattgtgcacgcgtttagttgttgtgaacgcgatgagtagccggatgtgagttcggttagcaataaggtggtaccgcgcgtaagcgccctttggataatttgatcgattattcaaagggcgctttttcgtcaagtgacacatagcattattttttagttaacacatagtagtcattatttaggtcgcgcatcgcggttaatcatcgtaaacacatagttgttcgacatcacgtgacagcacatagtagatcgtaagcacgggcccgtttattggaaaagcactgaagcgagcggggaacatatacacatagtgggcaagacgaaaggatggttttacttatgaaatatggcattattggcgcaggcgcaatgggatatcggtatggtgtaatgttacaagaaaacgccggtgttgacgttgattttatcgacacgtgggaaccaaacgtcgcaaaggtccgtgagcagggcggcgttgatgtggcgcgtgatcatcaaaatcaccatgtcgttccaatcaatatttattatcctgaagaatatcagggtcatccagatgtttggattgtttttaagaagcaaatgcagttagccgatgagctcaagcgcgatgcgtcgttatttcatgaggaccagtacgttttcgccgcaatgaacgggatggggcactttgaaaagattgcacaatatttcccagaaaatcacattattggtggtacggcgatgattgcaacggtcttgaatggtccgggtacggttgattttatggggcctaagggtagtgaggcgatgcatatgagtaagtatgcaggtcctattgatacgactaccaagcaagtgatggccgattttaaggcggctgatttaaatccgatttggtctgataattttatgggcatgtgcatgtccaaagttgtgtttaacgcggtcaccaatagtttgtgcacgatgttcgagattcagatgggccaattcatcgaatatccgggcgtcaaggatatggcgactcaaatgttcaacgaagcctatgatgcttgcgaaagggcaggcatcaaactcattgagacgcggcaagaagaaatcgactcggttgaaacggtcagtcgagcctataagtaccattatccatcaatgtatcaagacttctcaaagggacggccaaccgaagttgattatattaatggctatattgctaagattgggcgggaacatgactacgtttgtcgcgtgcatgagtttgtgactcacgaagtccatttagcagaaatgatgcggcaataccggcacccggaaatccccgttgctgaaaaataagattattaatgaaaaagttctgagtattttcagaactttttttgtgggcggaaaaacttaatttagtaaggttgaaatcggtttctttaacattggtctatacacttaggtgaccttgtaaacttgcaatgaaaacatgttgtgataggatttataacgtgcttaaaaagaggatgaggagaaattggtatgaagacatattttcagaaaatcggtcagtcattgatgctaccgattgcaacgttgcccgcagcagcgattttggttgggattgggaattacctgccaaaacagtggctgtttgcaaattacttgattcagggtggtaacgttgtcctgaataacttagccttgctgtttgcagtcggcttagctatcgggatgtcagtcaataaggacggcgcggcagctattgctggtttgatcgcgtttgaagttccggtgatggtgttaaaaccagcgacattagcgacgatgctgaatgttaaagtgagtcagatcaatccagcatttagcgcgttagataacaatgtgctgattggaatcagtgctggactgattgcggctgcgctctataatcggttccacgaagtaaaattaccaatggcgctctcattctttagtggtaaacgcctagtgccaattatggctgcttttgtgatgctgattgtgacggcggtattgtaccttgtttggccgtttgtctacgatgccattgtcctctttgcaacggggatttcaaaattaggtttcgtgggggctggtctatatggctttttcaatcgtttattgattccgactggtttgcaccacgccttaaattccgtattctggtataacgttgcggggatcaatgatattggcaatttctgggccagccatggtgttaaaggaatcacagggatgtatgaagctggattcttcccaattatgatgtttggcttgccagctggtgcgtatgcaatttatcgtaatgcacgaccggaacgaaaaaaagaagtgggttcattgatgttagctggtgcgtttgcgtcgttctttacgggggtgaccgaaccgcttgaattttcattcatgttcgtggcatggccgctctacttattacatgccgtttttatgggactatcattaggattcgccgcgttaatgcactggaccgccagcttttcgtttagtggcgggttagtcgattatttattgagttttcggatgccgttagccaaccaaccctatatgttactggttcaagggctggtgatggccgtcatttattactttggttttgactttgcaatcaaacggtttaatttgaagacgcctggtcgtgaagttgtgtctgcagatgtcgatggggtgggtgcacctgctagtccagcggtggccgttgcagcaacggatgataagtatatgcgccaagcaaagcaaatttatgcagctattggtggtcatgacaatattagtgtgatcaacaattgtacgacgcggctgcggttacaacttaaggatacggaaaaagtcgatcagccggccgtaatggctgctggcgtgcctggtttgaacgtactggatgttcataacattcacattgtgatcggcacggaagtccagttcgtcgcggaggctttacaaaaattattttctggtcaggtggcgacgaccccggcatctgatgctgaatcaaaggccccggttgaaccgcaaactgctactgtaacggaagcgccggtgacaacgattttgcgggcaccggcaacgggacaattaatgccgattagtacggttgcggatgagacgtttgctggtaaactcttaggtgatggttacgctgttgaacccgaagatggtgaagtcgttgctccggttagtgggacagtgacaagtgtctttccgaccaaacacgctatcggtttgaagacgacgagtggtttagaagtcttattacacatggggatcaataccgtggaaatgaatggtacgccgttcaagttacacgtggcaacgggtgatgaaattgcggccggtactgcggtagcgacggttgacttggctgctatcaagtcagccggtaaagcgacaaccatgatggtcgttatcaccaatatggatcacgttaacaaactaacccttaatccaactggtcatgtgactagcggtgatttgattggcgcagctgaataagttacgcgctgtcgacgttgggtttattgaaaaagtttcgtctaaatcttttcgatttaggcggaactttttttgtcgcattggttatcgaggcaacggatgacagcaaatgaacaacttgatgcggggacagtgcgtttgattgcttcccactgactcccacgatatactattggcattataggggggcagtaacatgattgacgaagtattagtattgaactcaacgccaacggggattttacagaattcagtttcaggaagcatggtgattgacgcggcacttgatgcacgactagtcaagcgactaatgcaggcgctaactcaatcgatgcttaaggtcagggttgcaaccgcggacgacttaccggtgaccgaccaccaattgctggtcgtcagtcgaccagtggcagccgtgttggacttacaagctagtgcgcgagttctgatttatccagaagcaacgggactgacagccgctggaatgacacagctagcagtgcaaattgatcaacgattgactaaaatatccagataacgatcaaaaaacgcccagggcagttgttcgcaagttactgaacagttgccctgggcgtttttaatgattagtctttgtggtgttttttaatgatagttactaatttcaatcaagttgttatcaggatcacgaacatacagtgacgtcaactttccgtgggcaccagttctttcaaccggcccggcaatcacatctacgaaataactctttaagtgatgctgaatatcatcaatattatccttcgcaatcaagcaaagatctgcactgccgggtgtcggcttagccgcaatgggttggtgtggctggttagtggtctgaaagttaattttttgtttacccactaagacagcttgacggtcaccatcgaaggtcacaatgggaaggtcaaatacttcatggtaaaaccgtaatgaccgtgcaatgtcagtaacggttagggtcaaatgatcgatatcgcgaatattcacaagctcaaatcccttcaaaaataattcattattaaacgtgtcgtactcatcagatttggcatgaaccatgattaaaatgtaccagttagattgctgttcgtcagccgttgcgcgtcctatgccgacctccggggctgggtgccaattgctggaacgcagccgacatcgatttgagctaacgcataacccgcgtcatctcaaatacgagtcttattctaagccggaagcagaccacttccagcttagaataatttggctactgagcattgtcacccagcccctccagtctcaagcctgtgagaggccacgggttgaagccgagcattgtctagccaacggattaatgcggtttgggcattagtccgttggcgtagcaagcacaggctttagcggcaccgaacacgtttttggaaccccctcgaatggcagattaacggccacttaacttggtaaaatttgtcgctgactattttgacaccggaaccttaaacgaaacgtcagggttccattaaccactttgtcgagacgttcgattattactatgccacttgaggaatagtgagctcccacaatatcactttcagactgacaggtaattaacaaaattaccgtttatgaggaacaatgataagtccatcaaaggttgggtacatcttcgtcagccattcgaatactgtcccgactggaaggcgtttcggccaatgctcagcggtgaaattccacttagcaagcgtccttggcttggttagtggaagaccagtatttaagacgtgatctgcggcttaaatctgtgtccaccgcgttccagcaattggcagaaatgcctggaagtcggtgtaggacgtcgctaactaagcaagtttacgctaaatagatctttttccagcgggcctaagctggctgcttttgaactgacacaactggtacgttttaatcatgattcatgccaataataatgagtataagacggtgttattcagtataccacgattgataatgggacggatgtgaccgtatttaggaagcaactcaaaaaacaacaactgtaaccgttcacaccgaacgcgacttttgacaatgcttgcttttcatagtaatgtaggtgttactataagaaggagggctattcgtgataacaattcgaccagccgatcaagacgacgcgggccagatagcaccgctaattaatatgatttttgatgaaatgcaacttgaggaactagacgatattcctgaacctgacttagagcaggccattactgccgcttaccggacacctgattatttgtctggtaaggcaacgacggtagtggccgaggccgatggtcaagtggtcggggtagcgtttggttatcctgacaaaaatgaggacgcggtggacgacgtgttagcacgagttactgcgaataatgatgcgtttggttcagcatttgaagctgaagctgaaagttatgagcacgaatggtacctggattcgattgcggtcgacccgaattatcagggtcatgggattggcgggaagttactcgccgccctgccaagatacgcgcgacaagctggtcaaaagcggattggtttgaacgttgacatggctaatttaggagctaagaagctctatgaccgttatcattacgaatcggtaggaattaagcctatcggtgatcggatgtacttccatatgcaatatgaactagataaagacttggtgctagcttagtatcagggctatcgcaacgggcctcgtgatatgacggggcccgttttaatacgggtcaaaatgaaagtgtaggttgaaaacaacatggctttactagaagtaacggatttatcgcaaagctttgcggaccgtaaattatatgacgatgcgaattttacgttggaacgagcggatcatatgggtatcgttggtcaaaatggggcgggtaagagtaccctaattaagattttaactggccagatcttaccattatctggtcagatcaagtggcagcgcaacgttcgaactggctatctggatcaatatgccgatattccagccggcatgacgctatacgcctttttgaaaacagcttttcaacgcttgtatgatttagatgcgcagatgcaacaactttatgcggattatgctgaaaaggtggatgaccagttattggaacgtgcaggtcggattcaggagaccttggaagccaataatttttatgatattgagacagaaatggaacgggtaattaccggactaggattagatgaaattggtcgggatcacgtcatcagtgagatgtctggtggtcaacggtcgaagatcatcttggctaaactattgctggaaaacccggatgtgattattcttgatgaaccgacgaactacctcgatacggcgcatatcagttggttggaagattatttgaacggctttgaaggggccgttatggtgatctctcatgactatgatttcttgcaacaggtcacaaactgtatttgtgacgtggcattcggtaaaattattaagtaccggggcgattttaaagcggctatgcggcaaaaagaagcacgtaaggaagcccaactgaaggcgtttgaaaagcaacaagttgtgattgaaaaagccgaaaagttcattcgcaagaacaaggccggttcaaagtcaacgatggcgaagtcacgggaaaagatgctatcgcatttggatcgggttgatccaccgagtgaaaatgaacacgccaagtttgcctttccataccttgatacgggttctcaaaatacattgagtgtgacgaagctgtctgttgggtacggaaagccgttgttggaacccgtgacttttacgatgaccaacggtgaaaaattagcgtttaagggctttaatggggttggtaaatcaactttgatcaagtcaattttaggtgtaattccagcgttaagtggtaagtcagatttttcgccatctgctaaaatcaattatttcaatcaagatttggaatgggataacccacagttgacaccgttacagacgattcaaaatgaataccctacgatgttaccgaagacaattcggactaagttggctaagtgtgggattaatgcggcgaatgcgatgaagccaatgcacttactcagtgggggcgaacagactaaggttaaattagccttgcttgaattggttccaagtaacttcttaattatggatgaaccaacgaaccatttggacgatgaaactaaagaaggcctcaagcgtgcattacaggctttccaaggtaatctaatcttggttagtcatgagagcagttttgtgaatggctgggtcgacaaggaattgaacgtcgagaaactcagtttgaaagaacgacaaggctaattcttatcctttttaatagcagtccatgcttgggcttgtctgtggacagacattcaagcatggactgtttttggatgtcctgattaggagaaaattatttttagctgactagttaatttgaaaatggactgctggcgattcagtaattattggaccgtcagcgcgccattgtccccatcggtaatcgctaaacccaaaaggccgttaatttgtaaatcgggaacgaatttacaaattaacggcctttttgggaacaattattaatctgttagtaattgactttcaaccgtggtctggtcgcgaccggcctgcttggactgatagaggtagtcgtcaacgcggacgaaccaatcagtgaaagtctggtcggttggttgcaattctgaaataccaattgaaacggtcacgttcaacgtttgagcgttaaatttgattggcactgttttcagtttacgctgaatcgtacgcattatttgaccagcttcaagcgctgagatgccacgaaaaatgatgacgaattcttcaccgccatagcggaagatctgaccgtgagtgctgcgctgattaagttcaagttcaacaaaatgcgccacgtgtcggagtacggcgtcgccagccagatggccgtactgatcgttaaaggctttaaagtggtcaatatcgaacatgaccatagtgacgggccccatttgatggtgctgatacgcggcaaacacttcacgcgcatgcgtgtcaaagctggcgcggttacgaataccggttaattcatcgtaattgacttgttgatcaaaggtgagcacttcattgaaaaacttttggacgcgattgactgctaaacgaatcaaccacatgtaaaggacaaaggctagaatgatgacgagtgtatggctcaatttgaacggatgaactgaccaaataacgccccaccaagtgccactatatagtatttggaacaggagatacttccattgagtagcgtgtaattcttgatagttatgagtaatatagacgactgtactaatcaagataatggccatggccagaaaaactggcaggtactgcgtgctgtggcccaaccagatggcctgaccataaatgaacaatggcattaacaggttaataatttcaacggccaggttgcgcatggtgttaaggctgaacagaagaatcgttaattgaaccgttgcgtaggtccaactgataatgctacctgaattcagcgtaatgaatatttgtcgtaataggatcatactaatgaggacacttaaagcctcggcaccatgggccccaatagtccaatatcgattttgacgacgatggacctgttgctctaggaggtaggtcagaatggtcattagggtgatcaggccaattgtaatgagaatgacaattagcattttgatattaaaaagatctcggcctaagctcgatagcgtaagtagatgtaacacagtgcgcccccataattgttgcgtttaattaatttgtcctttaatcataacacgttacgcaggtaactgttaacatcagtttgcaataatttaaaaatcatcaaacagtctttactgaaaaataacctagtctttacataaatatgatgatgatttaggcctcaatacggcatacttaccatgtaaggttagatagcaaacgcaataaaaaggagtttgtaaaatgctgcatggaacgttctatggtgtgatcttgattagtttcttgattggtatcggcgtgcagtggtattttcgtgaatactttcaattattagtgttcggccatagtgttgagattttatttatgatggtattaggttggtaccagttcggcatgctcgttttactaccgctgttagttttatggggaattggacttggtgcaatttatgtgatgaaccgattcgcgtaattagtttgtgtcgtggaggtgcccaatgagacgatggtttgtgagttacacgctaggaatgattgttggtgcggtgttatttttgtgtagtttagttgccattcattggttgggaccacaattatgggtgggcgtggctttaggtgggagtctattggtaggctgtaatattggcttagaagttctcaagcgtcattatcaagtgacgacaccacaagcgatttttaggttattgaattggtcctgaggtgcccataactgatagttgggtttgatttgaagcgggctaccgatctctgacattgcaattggaattcattaaataggcgcatcgagaaactaacatggtttctcggtgcgcctattaagctacagtttccctgtgcatgcggattaatgattaattttagacatgtcgtgatcatcgggcaacgtgaggccacggttagggacacttgttgaaaagacgatctgagtactcgtttttccaaatgtttgtaattggttgacaaactcgtctaatgcctgcgttgattcgaaaatcactttcaaaatttgagagtattcacccgtgatacagtcacattccagaatattaggaatgccggcaacaaatgggtaaaagcgctccttttgcgttggttcaagttggagttgaatataggcttttatgtggtaattgagcttttcaaagttaagatttgcttgatagtcacgaatgatgccactctttttcagacgagtgatgcgagcggaaattgcgggcgaagaaatgaagcattgatcggcgagcgcttttaaggagattcgcgcgtcggcctgcaaggcgttcaaaatcttcaaatcggttttatccatcgttaaaacgcctcctaagtaattattagtatcatagcatactttcacagtgatttttaatatttagtgtaaagtttctactgaaaggatagcttcttaacgtgccgaggtgccacggcggtggggggcgatcgattaaagttaaaatcacttcaaggtttgaccaggaagccagacgtggttccggagatatggtaaactgaaaaaatgaggtgactagaatgcaatcaacacggattattgcggccgttgcgaacgtgtggcggcagccaaacaatacgtccatcgatactccggcactagcaaatgtcggcttacaaccatggttggcgcagttatcagatgaagatactgtggctttggaacgcgacaatcgcatcgtgacgcaggcgttatttaacgacgtctttttagtcgaacagtttgtcaatggctgggcctatggttacgttgttaatcaggccgactcccggcatccacaggggtatccaggatgggtatgggcggcgcaattgtcgaccgtcccattgccggttcaaactgggccgatgattacgatacggcgtggctttacgccgttactatgcttagatggccgtacgttcttaaatcttagccttggaacggaactacccgttattagtagcaaagatcatcgttattatacggtccagaccccactcggaacgggcaaaattgcaaaacgtgcgacgcagtttgcatttagaaccgcgcgcttgacaccgggagcgacactcgttcgactcggtgaagaattcttggatttacgctacctatggggtggcatcagtgcttatggtttcgattgttctggattcgtctataccttgcatcgcagtctaggtattcgcttaccgcgcgatgctcaggatcagatcaagcaaggagtggcggtcgacatagcaaatgcccagcttggggatctgtgtttctttgctcataatcatgggaacggtgcggtacaccacgttgccctatatgccggtgatggctggctattacatgcacccacgcctggcaaacacgtgacatacttgcagttagcaagcacttatttacaagatgagttggtcgctgtcaaacgaaattggtaatgtgagttcaattgacttagatttaattaaagtagaatatttcaaaatattaatggggcggataaagtgaaacaaattaaatggtggctggtggcagtcttattagtcgttggcttaaccggttgtggttctcaaaccactaagcaacaagcaacgcaacgggcggcaagtactaaaaaaatatcgccgtatgtgaatcaacagacccccacattttacgtccacgggtttcaggggagtgcgaaatcaacgaataccctgattgcgcatgctgaaaagactgctcatgctcacaaagttttggtggcaacggtcagtaccagtggtcaagtgacgttgacgggtaaatggcgtggtcgggtgcgtaacccgataattcaagtcgtgttcaagaacaatctggcccagtatgaccaacagagtgcttggctggctaaggtgattaccacggttcaacaacagcacgcgtttaaacattataatatcgtcgcccattctgcgggctgtgtcgctagcgttaatatgctgatgacgcaacaaacgacgacttttccgaagatcaataagttagtgacgatcgctggcccgtttgatggggtggtcggggaagatgatgttgctaatcagaactcgtttctgacttctgggcaaccgaaatatttacatgcagcctatgaattattggcagccaagcggagcaattttcctaaaaatgtgcaactattgaatatcgtgggaaccttgaacgatggtagtcattcggacagcttggtcaccaacgtgtcggcccgttccatcaagtatttattgcgtgggcgggatgtcgattacaccgaaaaagacttttatggggcccatgcgcagcacagccagttacatgaaaatgctaaggtagcactggcagttgaccgctttttatggcatcgatgatatgaccggggctctgctaatcaatagttggtttgggactgtgagtcagtcacgttacgcaattagaatcaaaatcaaacaagctcatccggccttagtcaggtcagatgagcttgtttgatgatcgttatcctgaagtcagcgggttggtctgggctagagaaagaatagaatataagccgttcgaataaggtggtacaacgcatatagggtaattaaataaacaactgagataccgccatatacggcatatttataattgcgcatgtaaaaacctcccttataaaattacctttagtgtaaatcggaatctgtttttacacaatgcaaacgccttcattattagggctaaatttaaattaagtcaaagaaagagcattctgttagcgataacttcaaaaatatgataaagttaattgttagttcggtggacttcacgctgccggattaaatttacctcagattttggataaattaatttttagtatcatgtacttgccccagtattgagtattagaattatttacagatttcctgagcattaggaaaggatgtaattcaatgcgcgttaccattaatcgcggtcaagaggtctacactgatattcccttaatgaccgcccgacatcgctatatcaaagcggatgtctgggaaataaaaaaagcaattattgaaaagtcagccattaacgggtggacggttcaagcgctacaagcaatgaattaaaaaataaacaacggccacggcatttgccagtggccgtttttgtaggaggacgatttgaatggcgcatgaagtcagttatcggccattaatcagtattacgaacgtaatctggagtttcgatgcagtgaccaagcaactgctggtcctgcttattcagcgtgatcacgctccttttgagaatacctggggattaccgacgacgtatttgagaacggatgagagtgcggatgaagccgcattgcgattagttcgtgagaagttgggcgtccagcttgcccaattccatacagaacagttagggacgtttaccgcggtcgatcgcgtgccgggtgaacgctcactggcgttgacgtatatggtttatttgccagtcaagccggaactagttccggggtatggtgcgcgcgatgtcaagtggtttgccattacgccgcgggtggatcgtgatgatctggtcgctgatggtttggcatttgctggtgttcccgattcgcagacggagcgggagttttatcaacgaatcgccaagcagttgttaaccgccgatcatggcctgatcttaagaaacgccctacaacgtgtgcgcaatcgcctggactatgctcctacgatcttattagtgttaggtgagcagttcacactcaaacaggcgcgccagctgtatgcgattttgtggcggcagccagtggcaactatcgacaattcaaactttcgtaaaacccacgttcatttatttacagaggtggggacagcccgacctggctcttctggacgccccgctaaggtataccggctaaagtagttcatttgacacgtccaagtcggtatgctacttttatagcaccataaaggtaaaaaatacctaaataagcggaaggctaattaggaaatttgggggagtattggaatggtcgaaagtaaaagaaatagtgctaagctattatgggtcatcgggacggcctggctttttgatgcgttagacgtggccctgctatcatttgtgatgccggttattaaagaaagttggcagctaactgcaggacagttgggagcagtcagtgcgatcaccacgcttggcatgatgattggggccttggtatgcggctatttagcagataaattggggcgtaagccggtccttattgggacgctactgcttttttcgcttggtaatttgttattgacgattaccccgaacgtcgagtggttcttagtcgttcggttgttgactggcattggtctggggggtgaactaccggttgctgcgacaatgattgctgatcattatacgggaacacagcgctcacgcatgctagtcctggtagatagtttttgggcgtttggctggattgcagcatcgttattggcctttttagtgatgccacacattggttggcggatgacggtcttaatcaccgccttaatggggttgtatgcgttgctgttacgccgacacttacctgcagaacaggaggctaatcggccacaaaaagttgattttagacaggcattgcggcaagtgtggtccgctaaatatcgccgagctacgatttgcctcagcattctatggtttgtgattatgtttgcctattacggtatgtttttatggcttccaagcgttttggtgttgcgcggattttcattagtacatgggtttggctatacgatgttgatgagcttggcgcaacttcccggctattatctagctgcgtggttgatcggcgtcgtcaagcgtaaggcggtattggcaacttatctgattgggacggtcgtcagtgccgcagcttttgggacggccaataatccaacgatgattctgattagtggtgcatggttgtcgttctttacgctaggggcgtggggaattatgattgctttcacaccggggcaatttgcgcccgcggtacggggaattggtatgggcgttgcccagtcaattggtcgcattggcgcaaccatcggcccatttttagttggtgcgctgatggcaattggatttggcattccggcaatttttatggtgttcgtggccgtactcttactcggtgttggggtattgctattcgggttaccgaatcaagagacggatgattaagtatcggtggcagatataaattaaatcgtaagttaaatttacttatatggaatggactagtgatgtgggcgctgttgctgaatttgaattgaaatgattcaataatattttttgtgaaagttaaacgagctcagtgatgacgcggctttgagggtgtcattcgttgcgaagccaaagtgaaactcctatgattacactgaggagttgaaaaaaatggcaaaggcaaaagcacgtacgacccaaccgaatgaacgattaagtgcccaactagcacttgccagcatggcaattgagattcgaagcgatgttgtgttgaccaggttagttgcgcgggctcgtcgccggcttaatcgtagtggtgacagtattgctatcgcgcaccaaatcgctgctgatctaggttattatttagtgtgtcatcaatacaaaatgccccgagctgcttatgatttgttggcagttgcgtatgaagtaagtgttgagacgcccacacgagcgactattattcagttaccgtcacgaaaaaaatagactaggactatcaattgattcacacttatattagaatataatgataaatagatgtgcaaaattggagggaattgaatgggaaggtctgaacaattaaaaaaactcgtcttggcagggttatttgccgccattatttttattggtatcagtgtattacgaattccgttgcccgcgattgttgggcggccatttattcattttggtaatattttgacagtgctcgcagtgatgctgcttggttttggctatggtgctacggctggtgcagtggggcttggcttgtttgatattctgaatgggtatgccgcaacttcgtggttaacaattattgaagcaattattctggccgcgatggtcaacctgagtttcaagtcaatcggctatcgtgaagatcgtatcggccggctttactgggtatcgttagtcgcagggctcacaaaaatcgtcacttcgtggtgtacaggcgtgattgaagccttaatggtggggacaacgctcaaggtcgccatgattgggtccttcacgagtttattagcagcgaccattaatgcggtggcatgtgtcatcattgtgccgttattgtatcggatcttagtacaggttgggtttaaccgccagcgggtcggtacggtctaaatggccgcatgctaacgcagctggattagtgccgtgagcgcttattattttaacagactggttgcaatccactttaacaccgttggctgtggcgtttataattattggacagatttcggttgatcaggttaaccatggttgtattatcggtaaaaaaagccctttccaatttggaaaagggctttttactgaagtagcacgctaatcaaaataggacaaaaaaagctatcccgttaggatagctttaatgaatattgatataacaagtgttctggagcttattacatcactttgaaactcagtaatggagatggcgagagtcgaactcgcgtccaagcatattgcccctcggatatctacgctcatattcatactatttaaatttcatcattgcaaacgccgtatgacagggcacccagcaatgactaacctgattagtctcttctcgcaactccaggtggaagctttgagcgtaagtccactaaatttaggacccagatccagaacatggacgatcctgggaggatctacgttaagcgcttattaggcagctaaagcgtaagaattgttattattttttgcagttataatttaaactgagcgtttttacgtagacgcaacctacgaagcgcaatccgaactcaaactatacctgtcgaatccagaacatccccaaattcaacaatcctagtttagcacagctcaactgttctgccaactaatctgtctactggtcatgacaatcattacagcagtttaagatgaagagtgtgctcggcggcgccgcaaaaagtgcaacattttatgtgtgttcagtgaaagtgccatgactgccaagataatcagtaagccgccgataaaatcgaagctagtgagttgaacgtttagaaaagtaatcgagaaaaccgtcgcggctaagggctcgaaggcgtccatcaaactggccgttgtcggtagaatatcgcttaaactacgcgcaaacatcaggaagggggccaccgttcctaagagaataatgacgattaacaagcctaattggggccaggtaatcgtcaggtggacacgccacatgggttgtaacaaggttagaaacagacccgcaatcagtaacccccagccagtgacggttaatgcgccatactttggtaaaatggttcgcggaatcaaggtgttcgtggcgaccccgatggcggataagccgccccagaacaagatgacgggtgaaattgccagactgtttaagtgaccgtgtgtcacgatcaatagtgtcccgataaaggccatgatcataccaatcagttcgatacgactgggtgtcacgtgcttaaataagaagtaatagatgctgataatgaatgggccaagaaattgaataatcgtggcaatcggggcattaccaacgcgaaccgcttcgaaatagcaaagttgaaccggaatcagccccagcaaaccgtaactcaccgctgtccaagcggcatggcggtgatgccagattttaaaggggtgtttaccagccaccatcccccagacgagtaaaatcaagcctgcactgatcatgcggacctgcgttagccacattgcggttagatgcggattattgatgaagagggtactcgcagccacccctgagataccccacagaatacaggcactactagcgagtaagacgccccgtaaatgattttgttgtgtcaaattacgactcctttctgaaaataataagcaattttcattatagcaaaggtgcgtctgggaacctatgtttatgaggaatctcttattattctcatgggttacttcatcaaaagtaacgggtgcgtttcagaagaactcatgctatgatatgaacaatcaaacgcgaataatgatgcgtctaacggaggctataaagatgaaagcaattattaccgttgtgggacaggaccaagtgggaattgtcgcaaaagtagcgaacgagttagcacgtttaaaaatcaatattgtcgatatttcgcaaaccttgatggatcataattttaccatgatgctatcggcggaatgggatgaccagcaattaagttttgcggcggccaaagcggcgttagaatcgctcggtgaggcatcagagttaacgattcgaattcaacggcaagcggtttttgacgcaattcagaagttataggaggcggccatggaaagtcgttcaattttagaaacaattcagatggtggccgaggaaaatcttgatattcgtacaatcacaatgggcatttcgctctttgattgtgttgatagtgatggtgagcgggcccggcaaaaaatctatgataagatcacgactagcgcgaaggacctggtcaaagtggccgctcaaattcaagaagagtacggtattcctatcatcaataagcgaattgcggtaacgccgattgcattgattgcggctgcgagtcaggatcaagactatgtcgcgtacgcagtaaccatggaacgggcagctcaagcgctaggtgtcgatctcattggtggtttctccgccctggttcagaaggggtatcagagtggggaccgcaaactgattgcatcgattcccgccgcgttagctgcaactagccgtgtttgcagttcggtaaatgtcgggtcgacacgggctggaatcaacttggacgcggtcggtgaaatgggtcgtattataaagcagattgcggctgacgatccggtcaattgcatgagtttagtggtatttgccaatgcggtcgacgataatccgttcatggcgggcgcttttcacggtgttggtgaagctgatcgagttattaacgttgggatcagtggccctggtgtcgtaaaacgagccttagaagaagttcgcggtcagtcgatcgacattgtgtcggaacaaattaagaagacggcgtttaaagtgacacggatggggcaatttgttgggtccatcgcgtcagaacggttgcacgtcccatttgggattgttgatctatcactggcaccaacgcctaacgaaggcgattcggttgctgagatcctggaagaaatcgggttggaaagtgtcggtgcgccgggaacaacggcggcgttggccttacttaatgatgccgtgaagaagggtggcgtgatggcctgcgaacatgtcggtggactgtcgggtgcctttattccggtttctgaagatgctgagatgattcgggcggtcagtgctggtcgtttgaatattgaaaaactggaagcgatgacagcagtgtgttcagttggtctggatatgattgcagtacctggtgatactagtgccgcgactatcagtgggatgattgccgatgaagctgcgattgggatgatcaacaacaaaacaacggcggtgcgcgtcataccagctaccggcaaaggtgttggtgatgcggttgaatttgggggcttgttcggtcaagcaccagttatgccggtcaacaccaatcaaccaacgacgttcattaagcgtgggggtcatattccggcaccaatccactcctttaagaattaggcacagtggacgttgtgaaggggcgaaccggcagtcatcctgaacttaaatggtgacttcacgctcgcaactcgtgaaatgtaactgaatgatgcacgatttcctggtcggtatgaacggcagaaaatcgtgctttttatgtcagtgagcatgactctggtatgatgtgtgactgatgtgccaagattattaagtgtccctcaatgatgggatgacacagttatttcacaaatcgtgcacgctttgttattaatttgttgttatactaatcctgaatcctagcgcgaagtagggtatgataatagataggttaataaatgatgattaatcaacaaagttagcaatcgtaattaacttggaggacgttgcactatgaaattattaatgattgaagataataaatcggtctctgaaatgatggccatgttttttaagaaggaaaagtgggatgcccattttgcttatgatggcaatgaagctgtcgaaatgttcaatgaagatgtcgatggctgggatatggtgacgctcgacttgaacttgccaggcaaggatggcatgcaagttagtgcggatattcgcaaggcttccccaactgtaccaattattatgttgacggcccgtgattcggaaagtgatcaggtacttggcttagagatgggcgctgatgattatgtcaccaagccgttttcaccgattacactgattgctcggatcaaggcccttcatcgccgagcagatttggctaagaccacgccggctgaccaacctgccagcacagtgagttcctttgatgttcagacggaccattttaaactgaataccaagacgcgggaagcctatttagcagacaaacaaattcaagacttgacccccaaagaatttgatttattgaagaccttagctcaaaagccgcggcaagttttctcacgcgaacaacttttgcaactggtctgggactatgaatattatggtgacgaacgtactgtggatgcacatatcaaaaaattgcgccaaaagattgaaaaagctgggccacaaattattcagacggtttggggggtcggctacaagtttgatgatagtggagttgacgctcaatgaaactgatttatcaacaaatgctagcgttctttgccgtcattattacggtaatcgtcgtcctcggattttcatttattcgaacgactagaacgatgctttatcaaaactcatggcaacaattgcagcagtacgccgcgagtattgaaaaggaagctattcggtataatacgaagactaatcaagttgtcgggtttaatcaacaatttctaaatgatgggaccgtcatcttacgagatcaacatattcacttttcggtatatgatgctaacaaaaagttggtctatccaagtggtatggggacaacaatgagtgggacccctggtggctcgatttatgatcccaagatctcagccaaagattggaagaagctgaagcggaataagattattacgcagtcgccccacgtaacgttcagaacacgcaatcgtgatcaacccgtgaatacaccgtcgttgcgaaccattgacgttttagtgccccttttctataagaatggagcaacgaagaagtttgttggggccatctcgattgggtcgtttgaacagaccttgcaggccaatgaacagcagatcgaaaaaaatctgttcattgcactgttagtctcggggattgcggctctgttgttaagttacattttggcacgttattccgttcgtcgtattaatcgattgcggtacgcgacgcactcggtcgcaaatggtgattttgacattcaagttgacagtaatcataaggatgagattgatgacttggcggatgatttcaacggcatggtcaactccctgcgaacttccaatgaagaaattaagcgacaggaaaagcggcgtcgggagtttatggccgatgcggcccacgaaatgcgaacgccgttgactacgatcaatggtattttggaagggttagcgtacgatgctattccagaagaagacaagggtcattcaattgaactgatgcaaaatgagacgaaacggttgattcgactagtcaatgagaacttggattacgaaaaaattcgaaccggacagattgctttgaacaagaccaattttgatggcgccgaggttttgcataacttagttgaacagctcacaaagaaagcggccgccgcggatgatgaattcaagctgacggttcccgagaaactgccagtatgggccgattatgatcgctttgttcaggtcttgtttaacatcatgcagaatgccattcagttttcacaagctaacgtgatcgaagtaacgggtagccgtacggatcatgcgacggttgtcgcgattcaagaccatgggattgggatgacaccggaccaagtcaaaaatatttgggaacggtattataaggctgacccatcacgaaagaatacgaagtatggtgaatcaggtttagggctagcgatttcacatcaattagtccaacaacatggtggttcgatcaaggttgacagtgtggagaatgaagggacgtgttttaccgttactttcccagatgaaggttttgataaaccgattattgatgattaacgtgatagtttaaagcgggtaaatccgtacggaccgggcttggggatcgtaatgatctcgaggcccggttttgctaatgcggggtaacggtgggccatagcaataacccatcattaatagtaggaacggacgtttaatagtaatcgattgcggaccttaagcctaatacttttcagcgattgacactgttctacctcgcactctgaggctaaatatgttacccttaacaaggctgcaaacagcgatttatcaatagtttagataagatttgaaatgaataggagaaacaacaactatgcaaagagtacaaattacgggaaattcgcaacgtaaagtcaaggacggctatcctttactcgtacaagatgatctcaaggatccgagtatgaaactaaccgatggctcttttgtggcgttaatggcaagttctcaatttatgggctacgcgctgattgcgaagcatcgtcggcaactaggctgggtcttgagcttggatgaaagtgagacgccaacgaccgattactttcgtaagttattcaaacaggcgttggtccggcgagcaacgagcatggatccacagttaccacaacgggtcttcaatgcggatggcgacggtctcggcgggttaacaatcgatcgttatcaagattactatgtctttacatggtacgcacaaggtgtttaccagcaacgcgaaatgatctatgcggcttttgaagcggctactgaacatcaatttaaaggcatctatgcgaaattacgatttaatgtcgaagaagctaacttaaagagtcaactcgtcacgggtgaagcagcaccagagccgttattagtgactgaaggcgcggtgacgtatccattacaccttgctgatgatttaacgaccgggttactattagatatgcgtcccatccgggaatggttggccggagccgaattgcaaggtaagacggtcttgaacttgtttagccaggaaaatggggttacggctgctgctgccgttgcgggtgctgccaagacgatttccattgaaacaagtaagaagggtgccaaagagaccgctgatcaattggcggtcaataatattgaccctgataagcaggaaattcgagcaatcgaagtgaacagctatctagattacgcccagaagcaccgactaagttatgacgttgttgtcgtaacggcaccgacttttgcgcgggtgaaaaagcagaagttccaagttgcaactgatttaactgacttattgacagcgaccttaccagttgttcggcgtgatgggcaattagtgattgcaacgactgcgaataatttttcaatgaagaagtttaaagccgcggtcacggcggcctttgtcggcagtgatcggcacttcacacttagtgagacgttccggttaccagcagacttcgtgacgcgcaaggcttacttggcaagcaactatttgaaggttctggttttgacactcgataagtagtgtgtgcgccataatttaagtggaatagaaaaaaattttaaagggtatttcggggaccgttttcattaattgaaaacggtccctatcgctaagaaaacgaattcatgaaaatataaaaataattatatttaaccctgaatccctgattgtgactggtaaaacggttacttaactggtaaaataattccttgtcgttaggcaagagagaaaacatagaaatgaggattattagtaatgggaattctaattgcactgattcctgcgattgcgtggggcagtatcggcttaattagtggccgaatgggcggtaccgctcggcaacagacccttgggatgaccatgggagccttggtatttggcttggcactctgggccgtagaacagccaactttaacaagcaaaatttggttgattgggattgtctctgggttattctggagtattggtcaaggtcaacaatttacgtcaatgaaggcggttggtatttcacggactacgccgatttcaactgggatgcaactggttgctaatgcgttggccggtgtgctgttattcaatgaatggcacggaaacatgtattggattggctccgcttctgtaattgtgttgattgccggggctgttttaacttccttaactgataagactgatccgaaccgtagtgcttctgaaaattggggtgttgggattcgtgccttgatcttatcaacgattggatacgctggctatacgattgtggtccattatggtaacgtcaatgcacaggcagttgtaatgcctcaagctgttgggatgttgctgggtgctttgatctggtcctttaaggataagccatgggttgttaaagcaacttatcgtaatatcgtcactggtctggtctggggtattgggaatctattcatgtttatggcaatggcccaaatcggacaagctgtcgcatactccctttcgcaaatgggaattgttatttcgacgtttgggagtatctacctcttaggagagcacaagacgaagcgagaaatggtttacgtggtgattggctcgatcctggtcattgttggtggggtcgcgttatccttaatgaaggcttagtaaagctttactaaaaaattaattatttgatttacagattaaaaaaatctgttgaaggtgcggtaacggtaagttatcagcaccttttttgttaataattgtatttattttttacacaaatgacgaaaatttacgaaaaaagggaggaagcgcttttcattattaggcgagctattgtataatatgacatgtaaatacgtatagaaagaggtaatagtaaatggcacacatttcatttgacagctctaatttaactaagttcgtccatgataacgaacttggcgaaatgcaagctatggtcacagctgctgataaggagctgcgtgaaggaaccggcgccggtaatgatttccgtggctggttaaatttaccaacagattacgataaggaagaatttgcacggattaaaaccgctgcaaagaagattcaagacgattcagacgtcctcgttgtaatcgggattggtggttcatacctcggtgcacgggcagccattgaattcttacacgaaactttctggtcatcactttcacgtgaagaccgtaaattcccacaagttgtctttgctgggaactcaatctcatcttcatacgtcaacgacttaattcacttaatcggcgaccgtgacttctctgttaacatcatttcgaagtcagggactacgacggaaccttcaattgcattccgggtcttcaaggaacgtttaatcgcgaagtatggtgaagaagctgctaagggccggatctatgccacaactgaccgcaagcgcggtgcgttgaagcaagaagctgacgctgaaggctacgaaacctttgttattcctgatgatgttggtggtcgtttcactgttttgacaccagttggtttgttaccaattgcggtatcaggcggcgacatcgattcattaatgaagggtgctgcggatgcccaaaatgaatacaaagatgccgatttatctaagaacgaagcttaccaatacgctgcttaccggaacatcttgtaccggaagggctacaccactgaaattcttgaaaactacgaaccaaacatggcgatgttctcagaatggtggaagcaattaatgggtgaatctgaagggaaagaccaaaaggggatctacccatcatcagctaactttacgactgacttacactcattgggtcaatatatccaagaaggccgtcgtaacttgatggaaacggtcgttaaagttgacaacgctactagtgatgttgacattcctaaggaaaccgaaaaccttgatgggttgaagtatcttgaaggcaagacgatggctcaagttaacaccaaagctttcgaaggggttattatggcccacgttgatggcggtgttcctaacatggtcgttaacattccttcacaggatgcctatacgttaggttacacgatgtatttctttgaagctgcagttgccatttctggttacttgaacgggatcaacccattcaaccaacctggtgttgaagcttacaagaacaacatgttcgccttacttggcaagcctggttacgaagaattaactaagaagttaaccgcacgtcttagtgactaaggtgctagcactttagaaattaagatggaagctcctaaaacaaacaactatcagctggctgataggctgcttgttttgggggctttttgcttgtctttctgacgctgtgttcgtagctgttattgagcgtcgtcgctaatctaaaatttatgaatcacaacgttgttggcgaaatgaatcgctacgtccgcaagatgaccctaatttaacatggtgacgctcgtaatttttgaccgcactggtcgcactaactttgaatgacatcacgcaatgaaaaatctgccgacctatcttaatcgtgagtggttggcatgtgatttaacagcagacgggttataatagattaggtgttaaaggacaaatatagtcatgcatggtagttgctcgcaacgatgtgtgatgtacgtgaggagtttgagatgcgtaaattaaacattatcgaaagtatcattattgttctcgggttactagtcttttggctggggagtgaagtgacagtaatcaggcaacaattgccatggttgcaatttgcagggctgattgtcgtatttgtgactggtttagcggatgcgatttaccgcgtggtcacgaagcggtccttttttaagtaggaatcctgctgattgaagttggagtcattaggtgtaatttaatacgatgaagcgtccgttactggcagtcagtgtgcctagtaatggacgctttttagttcatgccttgaatgtgtggggtgcttggatttatctctgctgacggttaagtcgtgattgccgtcataaaataagttcgaaatagaaaaaattttattgtaaaaatcagcaaaatgggtgatattttacaaattgtaactaccaagtaggcggtttattaggatttaggatgattataattttaattatgaatgatgaccacaggtattcaataacactttacatcattcaccaaaaatcgcaatgttattaatgaggaaatacattgtggggaatgtagttaataaaatagtggaggtacatatatgagctttttagaattacacgatattcgtaaggcctataccttaaatcaccaagagaatgtcatcttgaagggcattaatctaaacttcgaacggggggagtttatttccattcttggggagtctggtggtggtaagtcaacgttaatgaatattattggtggcttggatcatcattatgatggagatgtcttgttagacggccaatccttgcgttcaatgaatgtgcggcaaatggaccggtatcgtcgggagacaatcgggtttatctttcagaactttaacttggtaagttacctaactgtcttggataacgtcatgctttcattaaagatgactaagacgtcccatgcgcaacaagtccagcaagcacaggacctactcaagcgggtgggacttgagcagcagacgcaccagtatccaaatgaactatccggtggtcaaaagcaacgggtcgccatcgctcgcgcactagccagtgaccccgatattattatcgcagatgagccgaccggggcgttggatagtgaaaatacccaagaagtaatggatattttatactcaatcgctgcggaaggtaaacttgtgatcaccgtgacccattcgcaggaagtggctgactacgggacgcggatcgttcatttggatgacggccagattcatgacgaattagtgatcggggcgcctttcgacgtggtcgataagcaaccgacgcgttaccgaacacttggctttcggcagatgttccggatgtccatgcaacatatgcgtcgaatgtggcttcgttacctgctgattatctttggatcgtcgatcgggatcagtagtatcgtcgtaatgctgggcttgggatcagggattcaaaattatatgaatcaccagattacgtctcaagttaatccaaccgctgtccaagtatcgaagaagacggggaaagtcagcacggctgcgcgtaaaaaagcaaccagtgcagcagcttacaaagcagcggttaaccaagaacaagtcacagccgcgaagaatgccgaagtgacgactgcaaacgtcaaacaattagcggctatcaaacatgttaagtctgctaagctgggctattacacgagcacacaagcgagttataaaaaaacaaccgtgacggccagtctccagacggataaccccacaattttgagtaagacaattaaggacggttcacgtcctgaaaatggtcaagttttgattggtcgtaagttagctaagaagatggtgggtaagaaaaattatcaacaagcgctcaataagaagttgaccgttaaattggcaacggttaatcgcaagaatcagtccgtaacggtcagtcagacgctgaccgtcagcggaattacgggtagcgatgatactagcgtcgtggtcttaccacaaaccgtcaaaaagatgttaactgctaagaatgtggcttatcgaccaaattttgccattgttcaaatagataaattggcgaatgttaagcaagtcgaacaccaaatcaaggcaatcaagggaacgaataagaagcaacagtataactataccggaatcggtgatttaattgattcattgaatacctatattcgtttagccactaacgtattgaccggggtggctggtattgcgttattagtctcagcaattatgatcattgttgtcctgtacgtcagcgtttctgaacggactcgtgaaattggggttttgcgcgcacttggcgcccgcaaacgcgatattagtcatttgttctttgctgaggccttaactatcggggtattagccgccgttatggggttactgtttggagaaggttggcaattcttaggcaatatggccatctatagcttaattaagtatccaatcgttcgaatctccggggcagcaatgctgggcggcattacagtcagtgttgtcatcagtttattggctgctttggcaccggcacatatggcggcacggttggatccagtcgagagtttatcacatgaataaaagcgggggcgtagcaaatgtatttctttattacgagcaaaattgattcgacgccatcagctattgagttagccatgattcagcgtcaaaaattattcacaaagcaccgggtacctgcgttgatcgtgacccgtaactttgtacgcgatttacatcataatatgcaactcattgggtatgatgatgagttccaggtcaatatgtatgattattttcaaggcactacgaattacgaaggcgaaccgttaactgcggccaattatccacgggtgacgggtgaaacgctggaacgggtcagcgctaatgaatttgacgtcattcaacgggaacaacggcaaaaagcactgatgttaaatgcgcaggggaatattgattacgtcgatattctcaatccacagggcgcggtcagccgtcgagactattatgatacgcggggcttcttaacggtggcccagtactttgatgacaagcagaatattgtgttagagcaacactgtaatttacaacaacagcctgtcttagagacgtttttccggccaaatgagaagcaacaaccagttgccactcatcaacggctgttaaactatcacgggcataattacgaatttgaggactgggatcagctgactgcctttttcttagacgcgttaaatactgagtatggcggtcacggaaccatgatcgtggatcgtagtgatgctggaatgaatccgattgttaaaatgtccacagcagcgcgcaagtatgagttcttacacagtaatttcacgctggacccacttgacgttgtgaactcaccaattgtgccgtacactcaaatcgggttagatcacgccagtcaaatggctggtttgatcatgtccacgcaagaagagtgtgatgatatgacgaaccacattcataatgtgattccaactttagcgattccagttggtagtgtaagtgacgaacaattagcagctcgtccggttgactttaaggatcggattgagggcaaggtgattgccgttgctcgcttatcggcagagaaaaatttggaacaattgattaaggcggtcgcctatgttcatgaaaaacagtcgaatgtgaccttagatatttatggttatggtgattcatggactggatttaaagaagaaaatcggttgcgagccttggtcagttcgcaacgttggcagtcatttatcacgtttaagggctttgagcgcgatttgacaccggtctataaccaagcacaactgatggtccttactagccaatatgagggctttaacttaggtattttagaagggttaagtcatggcgttccggtggttgcctatgacattaagtatggtccggcaacgatgattacggatggtgaaaatgggcgattgatcacccccaataatttagttgaattgggcaaggtgattttaacgctcttacaacaccctaaacagttggcgaagatgagtgaacgggcatatggcaacagtagccgtttttctgaggctatgatttggcaacggtggaatgatcatgtcattcagcctgatattcaagcaatgaggggagttacaaccaatggaaacgcatatcacgtcatcggctaaacaaccacatgccaagtatgggacccgtgatttattgagattgatcatgacccatgctcacccgaagaagggactctttgtgattggaatcctgttgtcgtttgtcgcaacgatttgtagtcttggcattacgttgatgttgaaggagtttatcgacgcctttaaccatggtacttcgggtcaactgttgcttcggttaggcgctgtgattgtcgtgcagctatttgcaagtgttgcgtcgagttttctacttagttatacgggggtcgacgccgtttcgacgttgcggagcgcgttatggcaacatatcgtggacttgccgattccgtattttgaccataaccggacgggggaactgtctagtcgggtagttaacgatacatcgacgatttttgaattgatttcaagtcagttttcgaatgccattaatgggatcatctcaattgtgggttccttgacgttaatgttgttattaaacttccgcttaacgattattattttaattgtggttccattgatggccgtgatcattgtgccaatgggtcaagtgttagcgcggatctccaaagcgattcaaaaagaaacggccaacttaaatagtgcagcagtacaaatgattggtcaaaatcggttagtgaaagcaatggttgctgaaaaggcactgaaaaaacagggaaaagatcaagttgatcggatcaaaggcttcagtgtccgtcaaatcaagctgatctcggtgcttaatccagtgctaaacatcatgttactggccgcaattttcattatcattgtttatggtgggatcttggtacaaacgaacgcgttgacaattggaagtttagtagctttcttaatgtatgccgttcaaatgatttcaccactgagtagcgtaactggcttagtgactgccttgcaacaaacggtcggggcaactgagcgaatcgacaacattttagatagtccggaagaagataagcggttgtcaggcgaaacgctgtcaacaatcgatacggtcgactttgatcacgtcgattttggctacgaaagtgataaaccggtgcttaaggacattgatttgacaattcatcgcggtgagcggattgcattgattggtgagagtggtagcgggaaaacgaccttagtttcgctcttagaggcttactatacgccaactcgtggtgagctggacgtgaatggcgagacaatggccagttatacgattccctcgattcgtaatcagatcggctacgtgagtcaagaagtagacttgatgcccgggacgattcgcgataatctcctgttaggttcgacggaaccggtctctgatgaacaattgagtgcgttgttgacacaagtcggcttagcggactggctagctgaactgtcagctggtcttgatacggacgtcggtgaacggggcttgaatgtttctggtggacagcggcaacgtttggccatcgtccgggcactcgtccgccacccgtcgttattgattttagacgaagcgacggctagtcttgataatcagaaccaagaacgggtgacccagctcttggcgacgttaccagctgacctgacgactattacgattgtccatcggttaaaccagatcgaagcttatccgcgaattctcttcatggaggatggtcagattacgggtgatggcaatcatgagtccttattagcaacccatgaacgttatcgtgacttttatcggctgcagtatcaacacggttaaaaaaggccttagtgaaatattgtttgattattaaaattagtaagtggttattgctgagtgttggcaatagccacttttttgatcccgaaatatgtattcaactggataacgcgggttaaggtatgaaataaaactgccgtaaaaaatataaaaagtattaataattttaataataagtcgaaaaaagcgatatttataattattttttagggaataaatttcccgatggtatggttcataattcggaaaaaaagaggggatgtcgcaccaagtaactacgctgaaatgctgatattatcaggggtttaaacgctttctactggcatagttaactggtgataaatataaataatattgatattggacacaaattttgactgttaatgaaacgcgtaagttgtccatagtatacatatttactgattgaatatgatactgccctgtatttattcaaatattagtaattttattgacgattgtggggcgaattagttaatatttaaatcgtaaacgaggttacttgtttcacgttcgcattagtaatcaatattagttatttaacagactaaattaaattaatgattattgagctgctaatttgtgaacaatttgtaaattttctaaggaggatattaacatgagtttcttcagtgatttacatctcttaccagggacccacacatcatcacatactagttatgtcagcaaccaaccacttggtactttctatcagtttgtgttgaacgtgattgccgcaatcaaaggttaagcgttgctagagacgggtgttagggaattcaatgattaattagttgaattttctaaccgtttaatcaagtttgtcggaatttaatttgttttccaaactctcaagtcttgccatacaagtggctaggcttggggatttaaccattaactaacttaaaaggaggagttattcatgagtttctttactgatttgcacttcttaccgggaacccacacgtcatcatacacatcaagtgtttcaaatgacatcttcggtggcttccacagcttcatcttaaacttgattcctgcaatcaagagtttgttcagcaaataatcatagttaattttataggaggatttcaacatgagtttctttaacgatttccacgtattaccaggtacgcatacgtcatcatacacatcaagtgtttcaaacgatatcttcggtggtttccacagcttcgtcttgaacttgattgctgcattcaaaaagtaatttagtcaaacaattataggaggatttacattatgagtttctttaacgatttccacgtattaccaggtacacatacgtcatcatacacatcaagtgtttcaaacgatatctttggtggcttccacagcttcgtcttgaacttgatcgctgcattcaaaaagtaatttagtcaaacaattataggaggatttacattatgagtttctttaacgatttccacgtattaccaggtacgcatacgtcatcatacacatcaagtgtttcaaacgatatcttcggtggtttccacagcttcgtcttgaacttgatcgctgcattcaaaaagtaatttagtcaaacaatcataggaggatttacattatgagtttctttaacgatttccatgtattaccaggtacgcatacgtcatcatacacatcaagtgtttcaaacgacatcttcggtggtttccatagctttattttaaacttgattcctgcaatcaagagcttattcagcaagtaatcacaactaatcttttaggaggatttatattatgagtttctttaacgatttccacgtattaccaggtacgcatacgtcatcatacacatcaagtgtttcaaatgatatctttggtggcttgcacagcttcatcttgaacgttattaaagcgatcaagggataatctatttcgataaactaattaattaatatattaattaatgtcttgatattatttagataatgagggaggatatacattatgagtttcttttcagatttacactttttaccaggtacgcatacttcatcacacaccagctacgttagcaaccaaccacttggtactttctaccaattcgtattgaacgtaattgctgcattcaaaggctaattaattaacaattaaaggggattaatctcatgagttttttcaatgattttcatattttaccaggtacacacacatcatcatatacatcaagtgtttccaacgacatctttggtggattacacagttttatcttaaacgttattgccgcattcaagggctaattcgttaaatataactgaaatgccaacaaaatcgttatggtgttattaagcacgacacgataagcacgactaagatgatgggctggcaagcgatttgtcgcccatcattttacataaatgcagaaaatcgtgggtgctcggggaggattccatatgtcaaaagataatcaaaaaatgaccggtgattcggtttatcgggtaaagatgtataaagatggcaagcgttgggtttatgccggcgcaaccacgttagctttggctgcaggtttagtatttgccaacgttaatgcttctgctgatactgctgctagctcagacgcaaccacggaacaagtttctagtgctgccagctctgctgcaactagttcaacggcgacttcatcagctgctacggatgccagttctgcatcttcaactgcaacgtcaacgtcaagtacggctagctcaactgctactacttcaagtagtgctgccagctcgactgcttcttcagctgctacgtcaacaacgagtgcggctagttcttcagctgcaactgtcagtgcgactacaccagcaagcagtgatgcgacatcgacttcaacggcaactgttgcagcaacggctgctaaggcatcagttgcaacaccagcttctgctgcagcaacggcaaccacgactgctacgaccacggctgcgactacagccccaacagtaacggcaccagcttctgaagctgctaatcaaactgctgctggctcagttgacgctggcacggtatcaagtgctgttaatacgagcaaaccagacaatgtacaagataataccgcttttactcctacaaatgttacggggactcaaatcagtttaactgccaagcacacgtatgaagttgcggttactctgaaaaagagtgaaaaattggattggtcaaatgcaattggccaactaacaattacagctcctacctctaattcaaatggtacttggactgcaattggttatggtacgagtgctggggttacacaagttgattcgacaaccaatactgtaaaaattcttgcttctgatgttgcggattatgatacggtaacagctttattcgctttcacagcaagcgatgatgctactcaaggttctttatctgctccgttgacatttactggtagcacagcggttagtcaattatcaagcaatacaaataatactagtggtgcttatctaccatctgcatggacgtatacgacagaaactcgggacatttccgttgctgctggtacggttgttgtccattatgttgatgaaaacaacaataaaattgcggatgacactattgtccaaggcgatgttgacaatacttacaccgttaaccctgctactttcagcaattacacgttggatacgactaagtccagcgctttgactggaaaagttgccgctgacacaactgattcgaacggtaacattacggccgctggtactgaattgacattagtttattcacagaatacagaagcctcaaaattgactgttaactacgttgatgctgataataatacgatcttaccttctaagacttatacagaaggtgctgatggtactgcagctgaagttggcggtgcttacagtgtgaatgccgcttcggttgacggttataccttaacgggtgatgcaacccagactgggacctttgtttctgatggtaacacggttaccttcacttacacaaaggatgcagctcctgttgaacaatcaacggttactgtaaactatgttgacgaagccggtaacgtaatcaaggatccaactactacaactggtgataacggtacggcgtacacgattgaccaaccaacaattgatggttacacgtataagtcagctagtgattctttgacaggaacgtatgatggtaataagaccattactttaacttacaccaagaatgcggccccagttgaacaatcaacaatcacggtaaactacgttgatgccgatggtaagacgatcaagacagctactacccaaactttggataacggctcaacttataaagttgaaacgccaacgatcgatggttacacctacaagtcagctgatgcagccttaactggtacggttgatggtaataagaccattactttaacttacaccaagaatgcggccccagttgaacaatcaacgatcacggtaaactacgttgatgccgatggtaagacgatcaaggccgctactacccaaactttggataacggctcaacttataaagttgaaacgccaacgatcgatggttacacctacaagtcagctgatgcagccttaactggtacggttgatggtaataagaccattaccttaacttacaccaaggattcaacgacaccagttgaaaacaaagctaacttgacgattaattatgttgatgctgatggtaacactatcaaagcatccaacgtaactgaacatattgttggtcaagcttacactgttggtcaaccagaaattgcgggttacacttatgaccatgctactggtgatgccattgccgggacgattgcctacaacggtaacacagttacccttgtttacacgaagaacggtggcactactccaactgaacaaactaagacgatcacagttaactatgttgacgcagatggtaatacgatcaagagtgcgacgaccacaacttacaaagttggggacacttacacggtcgcaacaccttcaatcgatggttacacttacaagtcagctgatggtgctttgagtggtacggtggctgatgacgcgacgatcaccttaacttatgctaagaatgataacggcggctcaacgactgcacctaccaccgcacctggtaccggtgacaatggtaataacggtggtggcacgacgacaaccgcacctacgactgcacctggcactggtgacaacgtcaacggtggcggtactggtacaactacaactgctcctgttacgacgccaagtgacgatactgttgataatggtaatggttcatcaaacaacggttcatcaacgacgacttcaacggcaccagcaaccacggtttctgatgatgaagtaacgccaacgacgacggctactactaacaatgggactagtggggttgttcctgcatcagcctcattgaagccagtagttacgactaagacgacgacttcagacgcaaagacgttaccacaaacggatgaagacgaaaacgggactgccttggctgtcttgggtctttcaaccttattgatgggttcagcgctatactttggcgtttctcgtcggaagcatgaagcataataattagaatagcttgattatttgctgaacggatagaaaggtcagcgatgacctttctactctttgagcaaacaatcaagtttatggaggagttgcattatgaagatgttcaataaaaagcgcagagataagaatgaggattaccgtaatcattctgagcgtgcaacggcgacttcaaccgttgctgctcaaaagccaaaaccaaaggcgactcaaagtagtacgacccccaatgtgcggtcatctgctggtgtccggccaactagtagcagcgtgactgcttcaactagtgctccagttaagggccaaaaccgggtcaaccaacggcgtgctacccaaacagcagccaaaaacagtgtggccattgaacgcgaaatggctgacttaaacaagcaataccaaactttacgtggggagcttaaggtccaattagttcaggatcgtaagcacgaaaagcaacagtatgaaactttagttgccgaacagttaaacttagaacaacagttaaaggacgctaaggttactctgtctaaacaggacaaagtcgttaacacgaacgatagcgaacggcagggaatggtcaagaccatcaatgctgctcaaaaacgttatgatgatgctaagaaagctcttgctaagagcgatcaaaccatcaaatcgttggaaaagaagattacgcagtctgaacaatcattagctgatttgaagcaaaatgaagctgatatgcgtaaagcaattcagggcgaacaggatcttaagaagttattcgtgttgatgaagcaacaggagaagcaagcacaggatctgtatcaaaagagtgacgcaatcaacagtgaactcgtgaaactccagaagcgtgaacagactgaaacccgtgaacgttcgcggaaggaacacgcgattacgagtgcggaaaaagacttacataccgctcaagatgcgttagttgcttatgatcgtaagaagaagagtgctcaagacgaacaagaacgttcactcaacttgattaatcagaaaatcaatcgattacaacatgattatgatcaaaatgccacgattgttaaggggctccaacaaaagattgaaagcattgatgccaagttaaaatcggattacgggacgactcacttagtatcgcccgtcgaatttgaccagtctgcaaagtacttcttgttcagcaccgatctgattcaatcattgtctggtgatgaaaaggcttcgatggaaatgatcatgggcttattgaagagtgaagttaaggataaagctaatgttattacggttaactataatgacagcttgccagaaatttggaacagttaccaatcagctggcttagttgataaacgaactggcttgtacaacatgtactacacgattcaggaaaaggtaccgggtgccgttgcgaagactaaaccagaattacctgataatcctgcatggcaatataagcgcaatgctgataagcagattgtgtcaattgccgatgacggcggtaacccaattatgacattgaagtaccgtaagaatggtgccatttggtacatgacttacttcaatgggtcattagcaactcgtcgggatgtgtacgatgctgccgggttcttgtcagtcactcagtaccttgaccggacgaataactcacaagtgacactagaaaacttctatcgtccagaccactctttagcaatggtcaagcaatatggtagtaaccacgaattatcaattcaattagtgaacaaggaagaagccatcacgaatgtcttccattctgaagcacaattattgaactggtggttggcatcagtcttacaacaacaaaacagtgtgttggttatgggagttaacgccccattgttcgaccaatgcttacaagcaacgaatgataatttccatctcttaccaatcgtctctgctgatgatttggataatcaacacgtccaagatattatcaacggaaagagtaagttgtcgagcttagttgtaacggatcgtgatgttcagactgcgattgagaaacaaatgacacgtgatcttgaaatcaccgttatgccagctgcagaagtccgtgcgtaatcacggggttgttgatgatgccttgaacgtgacgcatgaatggggttttaaataatgatgaagactaatactaagaaggccaagtacgacgatgcggaattgttcgaaaaagtcttagtgggcatgtcatggcttgaaagccatcttcgcgagattattcaaacgatggtgactgatgcggacgtgtcgttcgaacagttcttgattctctactatcttgaccatagcactgatcaccggattacggtgaaagagctagccgctgaccgccacgtctcttcttcagcgatttcaaggaaactgacctacttgatcaacaatgacttgattgtgttgaacatcgatccttatgatcgtcggtaccgttatctaacgttaaccgccaaaggtgagaagttagcacgggtcattgaaaaagttaacgaagaacgccttggcaagttcctcgacgaatttggtcggattcgaacctctgaattaactgatgagcttcggatggtcagcaaagttttagtggataccaaggaaattaaaggctagtaaaaagaggctgtgacataactagcctctgtataagcaaatgggacgagaaaccgaattttggtttctcgtcccatttgcttacgcctttgatttttaaagttggtccctaccgtgaccagtttcataatgtttaacgccagtattacgattccggcttccttggtgaccttgtcgaaacctcgcaccgagaatcgattgaaatgtaaagaagccttcatcttgccaaaaactggttcaacatcgatcttacgttgagcgtagatctgaccagtttctggagctgaaagtaattctcgttgtttcgatttgaaatattcccaattttcgttcacggaaatccttttaagatatccttttggtgttagtgccgcggaaattagttgatgattttcatcatacttttcggcaatgtattctttaaagtcacgggtaaaaccatacttatcagtccgttgacgataagcattaaaattaaaccggacgttttgtggattgataaaataatcatctttttcatgatagtcccagttcataaccttacggtcatcactttgccattttcgactattctctttaagcattgtgccgtatggaattaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcaggttttaattgaccgttttgcatcggatcttccttgacccgcataaaggtggcatcgtgatccgtcttagagtagctgttacgttgatcataaatagcttgctgtgcttggtgttcacgcattttatcacgtcgtttatccaacttacgtttttgtgatttaacagtccggcgttgctgtttggctgggttcggggaaacctgcttagttgcttccacggtttcattaaggaccactaagtgatcctcaaccttgctaatcatgatatccaatagttcgggagtcagctctgatcctgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgagttaattgtgataagctatcggttgtcaaagtggccagttcatcagaaattctaaagcgacaaatcgtccggtaggacggaatttggtcggcaattaaccacccagctggcttgttttcacgggcaaaccgttcaattttacgactgctgaaaatgccatagctgtacgctaaaaggaccagttttaacatggcaccgaggttatattcccgcggacggccaaactggtaatcatattttagttttaaactctcaacaagctggttgatgtaacgagcagaatgatgctcttctggttggtaatccaaggcaatactcaaagtggtttgattcatgttataataatcttgcatattaggaatgtcctttcgaggataatttcgtagagtatcgggtgcgaccgatgctctttttttattttctattatatcaaaagcaggtctggaaaaatccgaagatttttccagacctgctttgtttctagagacttatgtcacagcctcttttagtgttaaatattgatcgctaatgagaacaagataaaaccaccaagtaacatggcaagaatcgccacgaccacccacaacacttgacggacgttgtgccgcacgcgtcgctcaacatggctctttgattggagatgctcatgttgggcattaaatagcgaagcattcgtgtctttgacccaatcagcaccatgctgaccatagtaggggttggtgttatgattgagcgagtgggggacccggccatttgatttggttaacggttgatagcgccgcatcgtaatcctcttttcaacggttgtttagtttttctgggccttataaggaacggcatagttcttaggggcgtcgctagcttttgcatacttccagtgcccagacatcttcttttcgagtggggcatcatctttgatgcaagtaaagcgagagccaacttcattttcgataatgaagatccggttaaactcgtgccgcgtctgaacaatgtgacaatcattgtgatcgataccaaaaacatctttgtataccaacaacattatctcctttggattgaatttaaaatagtgacaattttacaaggcttcacagacagtctacactatctattataaacccctaatcaagtccgtaaaccgttttgagtgaaaaaagataaaattgcactggcaagggtgtgacaattcataaaaagccacgcaggtaaatttgatcttacctgcgtggctttatccgtacttctgattgggtatactgggctcgaaccagtaaattacggattcagagtccgctgccttaccaatttggcgaatacccaataacaactatttaatagtaacttttccagcaaatactgtcaagactttgctgaaactttgtgtctattttttgcatttttgcttgaatatcgtatcagttggtggctaaactagttaaatggaaggtgagtgtatgtcgaagtcagaattagatcatttattcgatcatctgcgacaacaattgatcgtatgggcggtcacggccatcggattagcagttatgcgcagctttttgttaccccaattattgactttcgttttttggtgtagtgtggcctactgtttgctcttattcgttggtttagttgttgtgacgatttttaggtggcaaaaatcttaattatatttgacaagccgcttatcattcggtaagataataaatgaatttgtgcccgctggtcaaattggttaagacgtcgccctctcaaggcggagttacgggttcgatccccgtgcgggtgataagtcgacaaatatagagaaacgacaaagcaccaaaacgctgatataaaggcgttttggtgcttttgttttacactcgaaaaccactcaaacttgatatgttcttccacgattcttccaaaaacgaaaaaagtagccaaaatatagcagttcttggaagaaaaattaacaaatgattttgtaatcccttgcggcacaaggactacagcaatcataaaattatcattttttaaaatccttcgtccattagctcggtagccttcttatctgacacgccgttttcttcttcaataagatggacgtaggtgttaacggtcgtttctagtttttgatgtcgaaggcgatgttgaacatagggaagggactcatgatttaagataagaatcgaagcatgtgtgtgtctcatagcgtgtgttgtaactttgttgatctttagacggttacaaatacgtcctagttcttcgtttgcattcccattgcccacgatttttcctagtttagaccaaaatacgaggttcttaggattcttcatttcgtgcaattctaaataatctttctgcgtgctacgatagctcctcataaaacgacagtaggcgggccctatggttatatctccatcggcctgcccatttcccttagttggacgaaaagtctgtctacgggcgtcccattgccgtttaatgtgaactattccattattcaaatccaaattatcccacgttaggccagcagcttcctcgaacctagttccagtttctagttgaaacagcatcattagcatagtcatgtgatcataatcagccgttttaatgagatatttacgtagtttcttgtaatcggacaacgttaaatacttttcctctacgggcttaggagggcgtccagtgacgtgtgccttgtaagcaaagtctcgttttagaataccatcagctacggcgtccttgattgcagtgtgtacttgttgatgaagcttgtgagatgtggcaattccatgactgcggccaaattcgttcaggaacttctgataatctggacgtttaattgagctcataggtttatccttaaaatatgcagagacgtgacgccagttgcccatatacagctcatgagtatgacgcgatacaccgtcagttttgtatattctgatccaatcaagaaagtagtgctttagactctcggtgctacgtgataagtcagcaccttccagcagagcatttttagttttagtttcccactcaacagcgtcagttttgcgtttttctaaatgggtaaccgacttataattaccgtcatcatctttataagagacacgggcttgccatttaccattattaagtttggttactgacatgttttattcctcccagctggaaataacaataggttgacattcccaaacgtatgttcttttaaactgaaaatatataccccataatggggcattatagaatagttgttaaatgaattctgctgttagctttgaatagtacgcttgctatctaaatgaaatctcgttatttgggtaatctttttaagaatagttgttctgttttattcatcgtctttttaatgttaatactataggataaacttatttctgattgatgcattttaaatatgtcagatattatatatgataacagtattttattaattttaactatacgagaattgataactttataatccacagtagattcaaattggtcgtcaaataaggaaatgtctaccatttgttgggatggattatgcaaagactttgaacatgttgaaaacaaagtatataaataatcaaacttatcccttttccggaagagaaaactatcatgtatgattatttccttcatagatttaaaagatagttgctgagcaacagtttcttgtacactattttgattactattactgacaattaaacgtaagcaagcttcagaaatggctctaaagaatatatcaaaggtatattgatcattaattgggatgatgtgaaataatcttttaaataattggttgatttcatttaagaacgtcaaagaataattttgtgtacttctattgatttgaattaattcgatgactagcagtgttttatatgcgttattaatagtatttttaaaaaaaataatttctgaggctgacattttacttagtttttgcttataaaatgttggataatttattttgataaaatttgagtaatcattcacataactttttttcattatgctcttccaaatttatctaagaaatttagttttttttctttaggaagattcttattaggaagattattcactgtctcattgaccattattcgtgcagtcttgaagaaatttgtaacgtctgcagaatcaatttgttcaatttttcgcatgaatcttgcaattattaacgtacgacttttgtatacatagtctttaaattcaaaattcaactgcgaacatagttcttttatatcttcatttttaggaaatatttcgcggctaagtagtaaattaacatatattgaatataactcgtatcgtattctttctgaatcagttctaacatcgattgaatttatttcattctttagtagaattaagcttttatttatttctatcattatctttgtcctccatgtctagaaaagttaagcgatcaatgaattctgtagtgattgcattgatatttgcgttgtgcatactatcgtttatatcaatactaaaatagtctaactgttctctatattttgaattatacttgaatatttctctaaagtaatataaatcgtattgctgtaacttctccgaagtggatattcttgctttctgttgtcgtaattgtcgctcactagttgggttgctagtatatgcgatgggattaaagattattcccatattgtttaatgttttagtagaaaatgcgcgaaagttattgtctttgatagatttgaccacttgttcgagtaaatctattccaagaacggaatatggatcaataccaacgggaacaagatagtaatcactagcattaaatgcagcagttgtgtaaaaagaataagtaggtggacaatctataaaaatataatcataggccgtctttaattcttttttatagatgaatttgtctaatgaattttcagctaagctaccgttatttgttctttctaaaaatactgtttttaaatctccgggtattaagtctaatgcagcttcaccttcgtttaggtgtacaatcaactcgttcttttgaggtaatatttggtttcctatgagtaacttgttaatggaattattgcaaatcgtcgttttgcttttttcttcatcatctagttctttatataaatctttgggaagtaaatgatacttttcaaataaagattgtgttaaatttgcttgcggatcaatgtcaataaaaagaatggatttattatattcttgattaagcgtgtagccaatttcacggcatagagttgttttaccgacgccacctttcatatttataaaagatataaccttcccgatgctttttgttggttcagattcagacataagtagttcctccagtttttgtgttaaagcgagtgacgggaatcgaacccgcgactacagcttggaaggctgtcgttttaccactaaactacactcgcataagagccaacaatgggttttggtcggctcaacagttaattagaatgtacctacaattatttttgcttaagacgatcaaccatatctctttccattccttggattatgcggccacattctttccttgagtagctatcttttgtaagataaacgaaagcatacagattaataaaagaggttaagtcattagtaatgttatctatgagttcatatttcgacatatctttatccataatcttaccttctttcttttaaaagtgggtggcagggattgaacctacataacaatttcaaacgagagagaaaggctgaaattgttattctaccattgaattacgcccacgcgatgtacgtactaaagtaagcggtagtatgggttatttgttacaatgcgagcggcaggagtcgaacctacatctgaaagtatctagttagcaattcataggagtactgttctatcgttgaactacgctcgcgtgaaatggaccttgttgggctcgaaccaacgaccggacggttatgagccgtctgctctaaccaactgagctaaaggtccggaagctttgcaaataagtgctgttttttcacttatttgcaaagcgagaaagctaataatccattctggtaatttctggttctgaagttagatagtcactgacgtgtgctaaaaacttctggaaatgaggggtgtcattatggaaatccacggcttcttgatctttccagtgttcgataatttcgtaatcattatcactgtctaactttttgaaatgtccatagaattcattaccagcttcttgtgctgaattaataacaagttcatgaatgaaatcttcatattcttttttgagctctggtttaacatgcaatgcgacgttgataatcttcatttgaaattcttcctttgacatttagttttattattcatcatctgagtcttcgatgagctctagccaaatggttaatggttctgggttgaactctggccacattttcataatctcgtaagctctactcaaaacatgactttcgtttccttcttctaagtctttaaaaacacttaaagcgacggggttattagatagatcgtccattaaaatatttgttttatgttgccattcggtaactaatttttggtaatttattaaacgtcttgcatgctgaatagcgtagtctacaccattttcttgaactcttttaataaaatcttcgtactctttgaagacggcagactgtgcttgtttccaatcattagtagataaatcttctgatttttccataaatgacacctgatttcttactgcaattattttttctgttgctttaataatgatacaatttctgaaagatatttttcctcggctgttggaatgggatcggcttcgacctcctccttcttaggcataattttattaatcattttgactagtaaaaataccacaaatgcaataatcaaaaaattaatgacagaattaataaaggaaccgtatttaaaagtagcattgccaacttttaaaacaaggctagagaaatcaatttgccctaaaaaaacacctattagtggatttattaaattattaaccaatgatttaacgatagcagtaaatgcagccccaataataacgccgactgctaaatccattacattaccacgtgagataaattctttgaattcttgaatcaattaaatatcctcctgaaaatatattctagcttttaatgacatcctgactggtcaatgtgagtggcaggagttgaacccgcatggcaataagaaataagggaagggtatcccataagaagttgccgttctgccgttgaactacacccacgtttgtaatcaattagtgatgaagctttttatagagaaaatatgcaactaatactgatataattgccacaaataatagctcagtgctccatttaatggagcacaggctttttaaaaaataagttaaagaattgaacattggtgattctcctatgtttgattgagttaagaacctctatgcgagcggcaggagtcgaacctgcattggaaggtaggctatatttgaattaaaggaaccattctaccgttgaactacgctcgcaaaaaaacttgcaaatacgattttaagatctataatgtttttaagcatgtttcgtacatgccccttgaggtacattctctttcgtggtgagggagaatgtatttttttatgttaatgcgagcggcaggagtcgaacttgcataaatataggacttgagacctgtgagaagcgtgtaaataactgttctaccgttgaactacgctcgcgtgaaagccctaacgagggcttggacctgttagggtcttgcgtattgattgccccgtggtgctggcttggcgccggaattatcagcagcgctctgggtcatatattggtaattacctggattcttaacgctggtgtagtacttattggagtctgaaacaaaaaccatgccagaagcagcagtagtccaatcaccgttctgtgtataagaagcattgtctgtagtacttgtttcgctcgcttttttagcggatgacgtgctagcagctaatgattctgaactggctttagctattgaagagctttctgcctcagactgctttttgcttgcttcggattcagaactagccatactctctgaattttctttggattcagacttggaggcagcaatacttgcagattcttctttgctactcgatagggcgctctcagatgactccttttctttaatagagttagctttgctgatgctagactttctttttgactcattggaagcattttcctttttgtgcttagaagatatcctgctagaagtgcttgtctgatcagcacttgatcgatgagttggtgaggctatggttcctactgttagaaatagaacggctgctataagcgaaataaaggtatattttttgtatggcttgttaacaccattttttataaagtgattgatagtccaacgaatcgcaaaatatactattgcaatcaatgagataaaaaacataactgcgcaaaagttttccaaaacaattcctccaaaatatgttattccccaataacaataattttcccgaattataagtaatcccaactcctagcttttaatgacttcctatctggtctatagcaatattaatttctatcgtgatttttttgtgtctgtgcgagaagttccttatacttattaatttctgagttaaagcggtccggtatatcttcatttgggtgtaactttttccagatgaaaattacaatcattgaccaaaggcctgcacgaattaaatcttttagtttgagatgtcccgctgtcatgaatttaacgaacttatttaaaatccagtacataatagcgataataattattaaccatgtgagaataatagacatatcttcctcctagttatagtaataataatttctacgttgtttttgtttgatggtctgaccgacgtacagttgtgtaccagagtctccaaggccatctttgtatacatgagtgataccagtgctactatcatctaatctgtaaagcataccgtgatcagttttccacccataagccattccttgtgaagtttctatagatgaatatgcagagccaacgtatttttgtaacgtttcgacgtctttttgtccaaaaactttagcaaatgattggagttcgctttcgtttaatctcttcctgctagattcttttgcttcaaccttgtcttttgttatagcggctttatgaattttatcaggagatccatcaaataatttatcattttcaaaatctaagtcatcagatccgtacataagcgtacttaagctctcgtctgtaggcttccccataatggaaatcacttgtgactttgtcatgccgagcttgattttattaaaactgtattgttttttctttgcctttttagtactagcgttatttttgattgaagatttttgggctacagtcttcttagtgtcactattattctcggaagccttctttttgatgttgcttgatttttttgaatcaggattcttcgatttatttcttttactgcttgatttgcttgaatgctttttgctagagcttttattagtgtttttaatctgagagttcttttttgatgtactgatttttctcgagcttgctatcgtattcttactacttgatatatttttaaccggattagctattaatcctacaataacaaacagaaaagatgcagcaagagcaatcaagccatatttaaaagattgttttgaggcgccgcctttaataagtttgagaattccccgatatataaaatatataaatattaacaatgagatgaagaacattatctcggcaaaagtttccataattcctccaaattaatttatattaatctccgttgaatggtaccccgtattgataggacagttctctatatgaatagggaatatgaccattttcctcaataaacaacattcccatcaatccaactgagaactcatcagcttcacgttcaaacttagaatgtccatgtttaacggaagtgtagtacccaatcagcccctcatggaatataacgtgtcccagctcatgggcgagtatgaaatactgtgtaggcgtgtgtttaatagaattattgagtagtatgataggctcttggttgtcataagcatttttaccaagaggcattgccccaaaatcacaccattccacttgtatgttaagcttttccgcgattacaaacggatctgctgtgttataacgattgacaatagttttaacaatatcttttactctatccataagtacaactcctaatcatgcttgtggcgtttccagaaaattgttgccatagccacacgcacttgttgtttttcctcttcggtaagatcttcacccccataggtcatcgaaccctcatttgcatctaaaaaatcttgtaggtctttagtatctttctcgttggcccattttggtgtgccattttttccaagcaagtagtcagttgttactccaaagtaatctgatagctttattaagtcatcgttactaacagatcttctatcactttcccaacttgcaatggtgctttggctaacattcattgcgtcagccagcatgggctgggttaaagatttttgttttcttaagtttgctattctttttccaatagtcatgtatgataacctccacaattagtattttagcttgtacagatagtaaaggatagaccttttattttatttgtacaaaaagacttgacttgtacaaataggcatagtactattagtacatgaagggagcggtgattttgaaacttaaatattatagagaagcaatgaatttaacccaagaagagttagcaagacatgcaaaagtttctgtagcaatggtccaatcaatggaaaatggcagacgaaaggggtctactgataccattctaaaattgtcggacgcgttaaacgtatctgttgatgatcttttgcgtggaaacgatatgactattagtcataaaaaggaaacatcaaaatgaaaccaatgaaaagtaaaagagccgctatcgcaaatagcaactcttcggattaaacgttaatgactgacaatctttaccactttggagctggcaaacacggtgccagggtcatcatcagtgaaaaagaaagtgtagttgtttagaagtttggtgatacttggcactaatcctagcttaatatgttcgttcagttcaaacggaccattaatttcgtctttgttaggaaaatcgtacgttatcttttcccagttctttttagaaatttttttaggacgatcattaattggcgcagtgcgaataccccaaacaaagtcatgtacgtttagcgttagtgtttcaccatctaaaaaatgaatcgtagctgttaacattttttaaccacctttttaagtgagaagtctatggaaactatttttccacctcgttgtaaggtgggaagtcgaagaagtcgtgaacgctgataccgagggtgccacataccttacggattgtagtaattgttggacgcttacttctcccttcaaacatcgcgtttacagtcgactggttcagcccagctaatgttgcaacacgattaatagttaagttctgttgagttattaattccattaaatgttcggaaacaaattctccatcggttttcatgttatgagctcctaacgatatattgttaagttcattctaaagtaaataacaaaaatatttaccaatatattgttgatatgtaacgatatattagttattatatggccaagttaccaatatattagtggctggaaaggagataccaaatgacttacacattaaggattcgagaattgcggcagaaactgggactcagccaatcagcactagctgataaaagtggagtaccgcaaacgacgatcagcgcaattgagtcaggtactaatttgacatacgagacggcgaaaaagcttgcccgtgcattgggagtttccacagatgaattatcagtggaggtgaccgagtaatggaagttatgcaagagaagttgcacgaaatggtccaaaggttccatttaggtgtgtctaatgtttatcaaattaacgagagcaacattgatgaagcgcgtcgaatattcgagttactaaaagcaaatatttaattttcaaagaacggaggaaacaaaatgacacatctatcacgaactacattaatcaatgcactagcaaaggttaaaccagaaacaccaagagtaatgtttgaggcactaagcgataaagcactagatgctgaatttcgagcagtaacggccgagtataacgagcaagctagccaacttatgtcagtttcatattaggaggtgcgaacatgtcagatacgatattgattcggcatgaggctccaaagggattccaattcattagcgaagaagaatacgagaagttccaagcctggaagcaagcacaacgtggtattcgtacttggaagcttaaagatttggccaagtataaatacggaactaaatcaaccgaacgagcctcacgatatttaaccaagcatcgtcatgatttggacattgaacagggtggcttcattgattatgtgaatacccataacggctggcagattccagcagctgagatgatcgattacctattagatcatcccgattaatttaaattataagtgaattacatggaaaggctatataaagccctttccaaaatacagaggtgtaggtatgaagaacaagtttgcagagcaattgtcattggcattaggcaaaaataaaacactaacacagcagcagattgcagataggacgcatgtttctcccggacaattgtcccggttgaagagtggatcaagaagtactgatccacaaatcaggaagtcgttagcaaatgtaattaacgatttttggcttagctattctggtgctcgtgagaatttcggagtgctgtcattccagaatgatcgtcagctacaaggtgatatgttctcggctttgatgaaacagaaaaaggaacagcgtgagcgagaaagaattgaggttgagtttgaagaagctattacagtcaagccgagagatcggacaccagcgcagcagctagttattgaacgttatccacgtgaatatgcagaagaaattagcgccgagataactgatttggctaagaaagctgagtatgccggcatcccaatggataaattgcaggaagtaatcgataaggtcaatcaagaaaatggataggaggtgtgataaaagatgcaagtgatttcaattaaaaagaatcctaagtatcaggcaggtggacagcctaaaaaatggctcaaaggtgttgaacttgctgctgaatggaatgtttcgccatcaacaataagcaacttggcgcgacgtgaagactgtccattgccgtctgatgttgcattaggggcccggcaatataattgggcggaagttagccgttggcgagcagaagagaacaaacgcaagcaggataggaggaaatagcaatgattgaaggagcagtaataggctgcacattaacagtgctgtggtttaaacgtcatgaagttgctagttggtttggaatttaaggagatgaagacaatgaaatttacgttcaggattggaaacgtgctttacaaacagctcacgattcaggagttagatagtctttttaacacgtttaaggaggttgaacgaattggaagtacgcaaagtatcgctaaagcctaaatttgagtacgaaaaaagctgctcgagtattggtagtacccgtgcagcaaagacgcttaataattttattttcgagttctattgtactccgaaattgtcgttaagacaacgtttgacatggaggtggcgaaatgaacggctacgatagctggttaattgaccaagaagaagctgcggaaggctggcgtgatgatgtgcctaccgaggaagacttaatcgaaagtggcgtcattgctggatattaaataggaggatttcaatcatggatgcaatgttaaaagaagaacttagaacggtgacagaacgtgaaaacgaaggcttcaaaattgactcattggagaaagctgactgggcattaaagaagctcaaggctatccaagcgcatgatgatgaaattggccaagttgcgaagaacaatattgaccaggcaattgcatggcgcgaccgggagcttgataagaaccaagccaaccgcgagtacttcgaagggctactgaccgactatttacgtgatcaacggttagtcgataagaaattcaaaatcgatacccctaatggccgtgtatcaactcgtaagaacccggctgggttggcgtatgacgaaaagatggttttaaactcacttcgtaatcagggcatgagccaatatatcaaggtcaaggaatctattgataaagtcgatttaaaaaaagctggtcgcatggttggtgacaagtttgtcatggaagatggcgagattatcgctggtattactgaaaagcccgcaactgagaaggtcacgtttaaatactaggaggaaccgatatgagtgaagcaatcgcgaaagcagaaaatcaaacgaacagtttatccctaatcatgggtactgatcaaaacaagatggctagcgaactacaggctatctctaatttccaaactatggttcaacatcaactaaaagatggtcaagattttggggttgtccctggcacacaaaaaccgacattattgaagcccggagccgagaagattcaaatgctgatgggcgttaatagcgagtataacgtcattgataaggttgaggactacgattcgggttatttcgactacaccgtcaagtgcgtgctgtacaagagtggtatgcagttaactgagggattagggtcggcaaataccaaagagagtaagtacgtttctcgtgatggtttttcgatgaaaaacacggtactgaagatggcgaaaaagcgggcccaggttgatgccacactgaccatcgctagtttatcaaatgtctttacacaggatgtcgaagatatgcagaactttaaccaacgtgagaataacgaaaccatgactcatgatgaagcctttaatttaaaacttaactttggcaaaaataaaggcaagagcatgggagatgtcatgaatgagaatcgtggctatattgaatggctagctgagaatgcacagaaacctgaatttaagactgctgctaaattattactagctggcaagcaacagcctgtagcagacgataaggcgaatgaagattttgatcctaccaccatcattgctagttcaaaacagacgagtgagattgctaaccttgctggtgaactggccacccaaaccaagaatggcacaccattatcagtgactaatgaggttattcaacaaattgtctctgattggaaagggactgatgacgattggaagaatctaacagtagcacaagcagaggatgctaagagtcagctaaaaggattgctagcagcatttgataagaaataaacattcgaattggcttgaatgcagcagtgactgaatccaccgaacgggtgaaaggcccattaataaggacaggaggtgcgagatggcccgtccaataaaagagggattggattacttcccattagacgttgattttgctgtaaacgacaagacagaagccattatgggcgagtttggaccaaaaggtgttctgtttatgatttatctgctgtctgcggtgtaccaaaatggatactacttgcagtggaataaattgaaacagatgcagttagctaatcgaattgaaggcgtatcacctgaattagctaatcaaatcgttaaccgcttgattgcttatggaacctttagcgaggaactgttcaattcggctaaggtattaacgagccagcgtatccaagagacctatgaagatgctactaaacgtcgcaaatcacagaaaccaactaagtattggattaatgttgacattaataaagatacaagtgtagttaatgtcgacattaatacacaaagtaaagtaaaggaaagtaaagtaaataaaagtaaagtaaataattatgatgatgacgcgggtgtcacacgcgagcaggtcattaacgattggaccaacctgtggggatttccgaacggggttgctcgtcctgaaattgatgaatggcttgcggtgcttaaacctgaatttgtggcttacgccattcaaattgctggtgaacacgatgtgcagtcgcgaggagctttgaaatatttgcgtgcagtgatcaagggttggcagcaacgaaagattacgacattggcacaggctaaacaagcaactgctgatcacgataaacggttggctaatgctaataaaccgggtggctattcaaagccacgccgtaaggaaattacgccaaagtggatgcaaaacggcgcttctcaggtggattctaagccaaactcaagcgataaccagaaggacgatatgagtgatgaggagttcctagcgctcatgaacagtcaggaggaagctaaatgaattggggcaatcaattagtcaatttagccgctaaccatgcctatgaaccggctgcgttgcactggactaagcagcgtatgaagcggcatttaaaggccggtggtagtgcgcaagatgaggtgtgcgctcatgagtacaagctatttgcactcgaggttttaattattgaatatcagcgggatggcttaaattttgatttgacccaatgttggggtaaaccagccgagtattttattgatctagagcaagctagacaaggattgcaaacggaggtgagtgcatgactgaaacacaggtgctagtaattaacgctgatttacccgatatcgatcacccactagcaatggggacagaaccggaaatgtttaagctcacgcaacataactacaaatctggtgaatggtcgtttccagttagacttgtgaagcctgaaactaagccatggaatgatgaggcctatctagccagtatgcgacccaatccacagactgaggaacgcgagcaaatcagggccattcgccgcgcttaccatgatgactgtcacacaattagaagcctagccataaggacggggtttactaaccagcaggtaagtcaccttgtgcataaatacagccttcgcttgcgtaaccaatactggcgggctgagaagtataacgatccggacgacgttatcacgggtcaaacgatatatatcttaggtgacaagcttgaggccccagctgactcaatcaagcaggcgagtcaatcgaatggacttgtccgtggctactacattagccgggtgccgcgagcatgagcaaagttgtgattaagggcgaactaccaagtttaaatgagtacatcaaggctgaacgggccaacagatacgccgcagctaacctaaagaagcggtacacggccttatgtagtgtatatgcgagagctagtcggaattccggagttgaattcagttggccttgcaagcttaaatttacgtggtacacgaaaaacagccgaaaagacgcggacaatatcgcgtttgctaaaaagtttgtgcttgacggctttatgaaggctggacttttaggcaacgacaatcgaaagcatatcacggggtttcaggacgaatttgcaattgacaaacgaaatccgcgagtagagatagaggaagttacggaggacaaagatgcctaaacacactaagaaatgttcaacgattaaacggaagcgccggcgcatgaaggaacacgccgaagcaaataaaaagccaaccaaagaggacggaaagtaattatgaaattaaagattgaaaacaatgatttgaccgtaacagttgaagcaactcgtgaattgagctttgaggaagtttttaagtcacatcagctggctacgggccgtgatgatgaattgagcactggtcgtgaagaaaaacatatgtttactccggaagattcaaatggactagttaaggatgctaataccgagtctgagttcattccggcaagtatgcccaaaaatggtgagatggtcaaagctgaatttatttgtccacagtgtggctacgataaagtgacacatgttaagtttggctttaaccactggagttgtcctggctgtggaattagattatttctagcgtatgcaaccggtactcgtggggaaaaagatgcaaatgggttttactacaaagctaatcgagaatttattagtcatgcacctgaaaacagtgatgatgatttttccaagatgtttacccggtcagataatccagagaagccggatgcttatgacacaatcccggacatcaaaaagtatcttgataagcacggcattgattattcccatgcaaagtttaaaggtgactatgttgatttaattccagaggattaatcatgataatcgtcaagaaaccaactaacgaggaacgaaagtgggcgtttgaagcgttcggggaggattgaaaatgtctgacgccgaatatgccaaagcaatccaagtaaaagccgcggttgccaacctggaaatgaacgcggcactgacaactgagcaacaagcacaaattggccgggactttatagatgatgttgtggagctgagtaatcgcggtagtaagatagttgatcaataaaaaagagagcaaaactattaatcttgctctcccaaaagttagggtcaatgaggtattagaaataagatatgagaagaaattatgataacagaatggcggttgaaattatgataagcattatcagtccaaaaatccaagtgaatcttgaagtttttctaatctcatcgagccaaaatgtcataaatcattcctcctgtcttgatttcacttaaagaataacaaaggaatgtaaatactgaatatcaaatatgtaaattatttgtaaacaaaaagccgcctgttaaggcgaccagtcacaggaccactcgaatgaccgttgttagtataacatataaaaaagccctcacatcaatgaaggttgacgtgaggatggggggacttcgttaaagtaagtccttcgttattttacaatagagcatgtattttgacaataataaataataccaccatttaggacaggagtgaccggtaatgttgccgattgaaattattgaattattggcgcctaaactgccatttgaacttttgacggacttgaatcagcggatgctggattggaaggctagcgggggtaatgacacggatgcttacatgtaccagcaatccagagtagcagaaaactattaccgtctggctttgaaaatcgatcctatggcatatgaagataaataaaaaagcgccatcattgctgaccgcgctatgattgattcctacaaaattaattatagcatacgaaagcggaggggcgcatgatgggcgaacagcaagttatttcagatgaaatttttccaccaattgaccaagagaaaacaattaaacaggtgcggcggttcctggataagaagttaccgcaagcagttcgggcgtccggccattcggtcgctgatttaaaatcgcctagcatggatggcatgcctaagtcggccccagctggtaattcggccgaggatcgaattacacgccgcctgtatgcagagcagattgtccgacagactattcaggccatggctcgctgtgatcatgagtgccaggagatattagatcggctatatctgcaaggatacagtgacacgatgtgctacatggatattggctacagcaagactcagtattttgatcgctggaagccattggcaatgctgcagtttgcacagagctattacctagaagacctgaatatttatcaaaaccggactcagaccggactttaaccgaactttttccgaactcaagccggacttcatagcaataaattggtggtaaattagtattatcgataattggttagggcgacaaataaacgtttttctgatagctctaattgattattattgtggccttagctcagttggtagagcgcctgactgttaatcagattgtcgctggttcgagtccagcaggctacgttgccagcggatttataaggggtgatgcgctcctctctgccgctggtatagtcttcgtgtttgacgtcggccgttaaatgcgagtatcgctgtgggctaattggtaagccacaatgggatgtaggttcgagtcctaccggcgatattgttaaattaaaattaaggaggaatcggttatgtttaaaattattgaacaactagtaaatgagattttacatggtcatttggtatcaattaacagatcaaatgaaaatttggctgatggtcagacattagctcactatgatttcaatgttaaaacaaaaacccccaccttaaagtgagagttctttaaactagaatctaggcaaactgagtagattgtcataagtcgtttggtttgctttagttcttatatatggatcacggtaaggtgggatgcactgtttcaacttcggttttattgccttcacgtgaagtgaaataatattcaaggctttgatcaataaaagtgaccacttgcgcaacggtttcttcactcccatctgatagttgaacctttttaatatcagattcgtcggtgtcaaaactattgtccgtatgaactttcactatttcatgtgacatatttctctctcctttcgttaaagatgaaataagtgtacatctatttgatagtactatgaatcacataattggcgcaattaatctggccaccaaattacatgcggaaacatgcgcgctgtggtaacataatcaaacatggttgcaaaaactataatcgtttttctgataacaactgtgtttaggagcctgacatttagttgggctctttttagtaaaatacatagtgtgtattgcaactcaaataatgttggatatagtatgatataaaattgtattgttgaataacaggatcgccatcttatgaggcaacaatacatgggtctgacttatgtcaggcttttttgatacataaaattagggaggtagcggcaatgccatgtatgatacacagcaaatatgggtacgagccgcctgaatgggtacaggctggttctcggctaggtagatggtacaagggtaagaagtgtcgtgcaaataagcatggcgcttttagtttggatacaaaaaagaaggcgatcacgccttcaaagaatgttacttgtcaaatttatctttcagattgtcaacagcatctttagccgtatctttggcatcagctaacttatccttagccttgccaactaagccttcagccttgccctgggcttcacgggttttgtcaccggttgctttgccttcaacttccttggccttgccactaactttatctttggcgttcttagctttgtcttctaaactcattttgtagcctcctgataaaaataattgtgaagcgtaattgttcgagtaaaaaggtcactgttttccgccagtgacctaaaggttattaactggataacccttgaacacctatagaataaattggtcttaattgaaagtcaaccaaaacggcatgttatgtattaatttcaaacgcgtcgatttcgactgggttaaaaacggaggtaaaaagtatgaattttggagaagcaattaatgagctaaagcatggaaatgcggtcgcacgtaagggatggaatggcaacggtatttatattaaattgcagaagcctgatgaaaattcatttatgactcatgagtacgtttatattgatacaattggtttacacacgaacaatccagatgcacccatggatcgtgttccatggctagctagtcaaactgatatgttggctaacgattgggtcgtagccgaatgacaatatataattccaattaacggaggtgtggtggtatgtaatggataaacgaaaagcggctggtaaagattacgcggccggaatgaagtacaaagatatttcagctaagtatggtgtaccgattggaacgctaaaatcatggcgaacacgcgacggttggaaaaaggatgcatccacagttaaaagagtgcaaccaaaacaaaaaaaagatgcgcccaaggttgcacctaaaataattgacgaactagaggcaaacagtgagcttacagataagcaaaaactgttttgcctcttttatttacaacgatttaatgcagcgtgggcgtatcaacaagcctataaatgtagttatgagacggcaagggttgaaggtagtcgcaccctcgcaaaccctaacataaagaaccaacttacagagctcaagaagcagcaacgttccgagttgctggcaacgattgacgacatcgctcacgagtacgctaagcaagcgtttgctagccttggtgatgtactagattacaaggtacacgaagaattagtgacagacaccgatggcaatgtgttccttgatactgatgataacccagtcaaaaagcacgttgctgatatctacttgaaaccgagtgatcagattgattggtcactggtgcaggatattcatcgcggtaaggatggtttggtggtcaagctgtacgataagcaaaaggcattagatagcttgtctaagctgatttgtgctgatgacaacaatgtcaacgaacagaaagtccgcaagctcaaagctgatgctgatattgcggaggccaaggcacatatcttaattgataaaggtgacgatactgaaaccaaggtgtcaagattactagataaaattgatactgtggtagaaggagaacctaaacatgataagtgatttatatacgccaaaacaacttgaagttttacgaactgtattgtggcgtaatgattggcgcttgctgataaattatggtgcggtgcgttcaggtaagactgttattgataacgatgttttcttgatggagttgcgccgtattcgtaagctagcagataagttagaagtagacgaaccaatgtatatcttggccggatattcaagcaaatcactacaaaacaacgtgcttcaggagttaacaaacaagtatggtatcgactttcaatttgacaagcatggttcattcaaactatttggcgtcaaagtcgtacagacgtttactggttcaattgctggattaggtgcgattcgtggtatgacttcttttggcgcgtacattaatgaagcttcgctagctaacgagacggtgttcaatgaaatcctagatagatgttcagcacctaactcacggattgtctgtgataccaacccagatgtgccaacacattacttgaaaaaggattatatcgataacgatgatcctaatgcgggcatcattagttatcattttacgattgatgataataagtttttaccgagtgagtacgttaaacgcaagaaagctggtacaccaaccggtatgtattatgatcgcagtattttaggactatgggtatctggcgaaggcatggtctatcgtgatttcaacaaagatacaatggttattccacgttcgaagttaccggacaacttaacttactatgtgggagtcgactggggctatgaacataaaggaacaatcgtagttatggctgatgatcgagctggcaatacctatttgattgaagaacatacacgtcagtttgaagagattgattactgggtagagattgcgaaagatattcagcgtcgctacggccgaaatgttaagttttgggctgatagtgcgaggcccgaacacgttgcacgctttcaacgtgaagggctcaaggcgttcaatgctaaaaaatcgattttatcgggaatcgagtcggtggctaagtgcatgaagcgaggtcacttttttgttatcaaagaagcgattgatgcgttcttagatgaaatctatcagtatgtctgggatgagactacgggcttacccgtcaagcttaacgatgacgtaatggacgcgttacggtatgccatctataacacacacgaacggctcaaggcgcggacaattaagaagccaaagggattaagaggataggaggtgagcggatgcaatatgatttgaacaagaagcgcgggtccaatgttgcgattgaccgtgagttagcggggaacattgaaaatcctagcttcgaagtgattaactatgctattgaccaacaacgagaccgtattggccgttatgacatgctggaacattactatgagggcaatcagcacatcttaagccgtaatcttgagatggcggctaagttggatcgtgcagatgaaaaggtcatgacgaaccacgctaaatacattactgacatgattactggctttacaacgggtaatccggtatccatttcaccggcgaatggtaaggatattaaagccattacggacgctcaagaccagatggacattgattcacataatacggaaatggagaaagatctaagtgtgtttgggtgtgcgtatgagctgctttacatcaagaaggtatcagacgcaactaccgaattagccattgaaaagattgacccacgtggctgcgtgttggtaacggatgacacgctggataaaaatccactgtttggtatttactacgtggaaaagaaagacctacgtggtaatgctgatggttatctaatcactatctatacggcccactggattattcagtatcgaaccaagacgggacgagtgttatcagatgctaatttagttagcaaacctaaggccgttcaacactattttagtggcgtcccgctgattgagtatcgtaataacgaagagcgtcaaggtgattttgagcaaacgattagcctaatcaacgcctataacgaattacagtcagaccgtatcaccgataaaaagaacttcgtggatgccttgctggtagtctatggctttaccctagatgagggcgaggacggtgaaggagctaacttgaaggacggtattctagaagcgcctggtaaaggcgaccagggtgctagcgttgaatggttgaccaagagctttgacgaatcacagctacaagtacttgttaagtcgattaaggatgacattcatcaaacgtcttacgtccctaacatgaatgacgaaaactttgcagggacgattagcggtgaagctatgaaatacaagctattcggtttactccaattgttagcgactaagcagcgatacttaacacgtggaattcgccagcgtctacaactgatgcagaacattttagcgtttaaaggccagtcagtagatgcctccggagcgacaattaatattgttcctgatattccagtcaacatggcggatgtcattagcaatatcaagaatgctgaaggtgtcattccgcaattggtatcactcgggtggttgcctgggacaaatgacccacaagagttaattaagatgctggatcaggaaaaggagaaagcactcaagctacagcagaaagctatgggcggcgagcctgccacagataacgaggaggtaactgcggatgattctggcaacgtttcaattaaacaaaaagcaggtagtgagttatcagataacgggccacgcgaatagtgctattaagggccatgacctagtttgtgctgctgtttcggtgcttggccaagccatcactaatgagctatctaacgccactattaaagaaaatggtggcttgtttattagattgattgagcccagtgctgataacaaagttctgtgtgagaccttattacacggactacaagatatttcagcacaatatcctcagaatttgcaagtggtggtgaagggtaattaactcagaattgaataaaatcattaaaacgattggtgtatttgtgatcgtgataattaaaatgcttggattagtttcgcttggatggaagccaattacaggcattttaattttgctgtatttgattttataagctcggaggtgtaggagtggcggatgacaaacgcaagttaagttactggcaactgcgagccgttcagagcgaacagaaatcacatgatgctgcaaccaaacaagcgactatcattgcaagggcgtacatgcgtgctcagaactatttgactggtgaggtatcacagatatacaaacgatattttacggacggtaaagcgacggaggccgaggcacaacagattttaaacaccaatgttagtccgactgagttagtaacgttacaggccctggctgataatgtcagtgataaggagtcaaagaagcaagtgactaactacttatcacagatggcagctaagggccgtattaccagattggaagagcttaaggctaagagctacattgcggtgaaacaagcggcatctgttgagattgagaagtccacgaacctttataccaaggtaattcaagaagcacttgatcaggcaactaacgagagtattataggtgactttgataaagacgtcattcttccgggcgtgagcgctgatagtcagcctaaaatgcacactagaactatctttgaccctaaaacgggtaaagagatggtaacagttaaagtgaacccagacgaaccaataacacggtttaaagagttgtcagggaagtacgttaaggctatattagatgcgccgtttaaaggcaagaactactctaaacggatttggcataacacggaccaactagccgaccgactcagtgaactattcacggctcagcagatgagtggtatgcgtgagcgtgacatggtacaagctttagctaaggagtttggaactagcagttacaatacgcgacgattgattagaacagaagccaactactttcataatcaaacgaagctcaatgaatggaaacgacgcggggttaaaaagtaccaactggttgccgtgctggatatgcggacttcaaaaatctgtcgtagtattgacggccgtgtatttaacgtagatgaagcggaagtgaatgttaattttccgccgttacatccattttgccgaactgtcgcaatcatctatttgtcagatagccagtacatgatgcaacggacagcgaatgatccaattactggtgaaaagctcaagctgaagccggatgctacttatcaggattggcgccaggcagtaatcttaaagcatggtccgcaggctttcgatagtttagataatcgggttggcaatcgtcggtatgatactacccagtatgatgaatacaaacggattttaggtggagataacgtacccgaaacattcgaagattttcaaacgatgaagtataatgacagtgatagttatcagaacctgttgaaagtagcgcgcgaggttcggcgcgaacaatttgcgttgaacaatgtacacaattttggtgaagtgcacggtgttccgtatcaacaggaagccaactcagtttttgaccgttatgtcgatggacaactagttacacgaagatattatggtaagacaggaaaggcccggctggacattgattttaccgaccatggtaatgctaaaatgcacacgattgtgccacacgcgcatccctggttacgcgttacaaagaaaaatggcaagattgttccccggcgtgaagaacctgggcggaaattaacgattgcagaaaggattgtgaataaagatggtggtaagacgagtaaaagctgattcggatcacttagagtctttggagcaactccgatttgcgttagatgttcgtatggaggttcaaatcaaaatcaatgatgttgagtggtacattggctttgacagtgagggcaaacgtatcatttctaaagataatggtgattttgattatcacttcaaagatactgacgacgttgatgagattcttgattatgtaattgatggcaagaaaatccgtgaccaatggcaagatatcgttattgttgcaatgtagggcgttcaatcattttgattgggcgttttttagtacgacgaggagaacacgatgagtaaagataattcggatttaatgcgttacaccgagatggcaatgaagggcttgacgtttgacgctgacacggagcaaggctttaagctcatgacggatgcatttctaacatgttatgaggaagcacttaataaaggatatgatcaagtaacagcaatacaaaccgccacgatgatcctttcgacaatgttccatcaggattagcatggatgacctgagcacgtctctaaactactcaaactaaatagcatgcgtgggtctgataatgacgccacggtcaatttagcacaatgtgtggggctcttagagtaatgcacggggtgctttttttgtggcctgagttatcggaaatgcgtgggcgtggaggaatttaattatgaaaaagctactcaaactaaagatgaatttacagatgtttgctgacggtgataatggaactggcggggatgaaggtagcaatcagacggctgatagcacgcctaacacaatcgacgccaatcaaaatagcaacaatgacgactctgaccaagacaatcaggcagatacgccgtttaaatcgtttgctagtgaaaaggactggcaatcaagtgttgataagctgattgcttcggcaattaaaacacatgatgaaaaacaggctagtgaagctcagcagcaaaaagattacgacaagatgactgacctggaaaaggccaactatgataaagaccaattaaccaagcaacttgctgaatcacagcgtcatggaactattgttgaaaataaagccaaagtgacggctcgactgggtgcagacgatttgccgacagcactgattgcggcttttggtgatgatgttttagcagatgataaaggcattgaagcggcttacactgcaatgagcaaggcatttacagagagtttacagcaagcaatcgataagcgaatcgcaagcagtgggaccacattgccgggtgctgatacatccgcaaataaatctgaaggtgcaacagcagctgaaaaattaaataactcgcaaaagccagcaaagtccagtttatgggcgacaaaatagggaggtactagattatggcctatgtatttgataaaggaacagtagaacaaaagaatttcatggcatctgaaaagttcgtatcattctcacggcaggttgatgacaccagttacgcggtgaagacggatgcttttggacataaagttattccagccggcacgatttatccaactaatgacgctaaggcggaaggaatcacgattaacgaagtggacgttacacgtggccctcaaatggttggcgtgattgttgaaggctatttatttggccaacgcttaccagtggcgccaacagctgaggctatcacggcattaaagaagattactttcactgatacggacgccgccgccaaatcacaagcctaattaaaggaggagaaaacaaatggctcaaatttcagatttattcacgcaacatgatttaatcgatttttcattgaatcggcagtatccagcgatgcaaggtgatgaactattcccagcaatcaaagtcaactcactaactgttgatatcttgaaacgtcaaaatcgaattccagtgattgcatcctatgcggcttttgatagtgaagccgaaattggcagtcggtctgcctcgggcgctgccatcgaactggctttgattaagcgcaagatgcagattaaagaaaaagatttgtatgcgatgctcaatccgcggacgcccgcagaagctagctacttgcaacaacatgtttataacgactttgatgtgctcaatcaaggcgttttagcacgaattgaaaagaccgctatggacgttttagcaacaggtaagactattttgccagatgaaagtggtaaacttgctgtccaacttgattatcaagttccgactgaacatcaggaagctttgactggagctgctacatgggataacggcgacgcggatatccttggtgatattacgcgctggtgcgataagatggatattacaccaacccgggcgctaactagtcggaagatttatcgattgattacgactaataccaaagttctacaagccgtgtatggtaactctactcgggcacttggacaagccgactttgacaccttcatgcaggcacaaggtttaccaatttttcggacttatgatcaaaaatatacccaagtcggaaaagatggcaagattaccaagagtcgttacttcccagaaaatcgacttgtcttaatgaacgatgacccgattggtaataaagtgtttggaccaactccagaagagttagcacaattcagtggcccagcgcaaattaacgctgtgggtaatgtttacgatatgatttataccgaaactaatgatccaattgggacttgggaaaaagcctcagcagttgcgcttccagcgtttgccgcggcggatgaggtatttcaagctcaggttttagcctagaggtgattgataatgaaggttcgcgttaaagattacccaattcggtataaagatactcggtataaaaaaggtgatgagctcagcattacgcaagacgcgttcaatgatgagctttttgtttgtcttgataagcagaaggacgagaaaactgccgataatgctcagttagaaacagacgacgaagaatagaggatgatcgtatggctaaaccaagcccaccagataaggcgggacaattgacaagactatatacgcgattaggtgttgagaaagacacgccggatgctgcggtggttgatgacatctttgatgacgctgttcaaacgtgcttggattatacccggtcttcactctcgacaccgattctaattcaggcaaaacggcttgccattatcatgtacaacgagcaaggaacagaaggcgaagcatcgaggtcagaaggcggcgtttctcaatcgtttgaactgggactacctaacataattaaaaccgcgctagcaccttaccgagtcgcgaaaacgaggcgattctaatgcgccttagaccaacagacctgacaactgtttatttacgacaacaacaatcaggtcacgatgatgaaggtaatgtcattacggcgggatggagcaatccaattgcagtgaggatgaacattcaagctgctggcggttcagtgaatgcgcaaatctggggcaaagaccttaagtacattaaatctggtaagtatcaaggtaatcagatcaatgaaggtcaacaagaaaattggggtgtttgtgtcaatgttactaaagatagcgagccagattacgttatcaattcgatacaaacattcagcacccataaaaatatcactttagagcaacgtaaacgaggcgaataggatggctaaagttgaatggcgtggcagtgataagctgaaagctcagctcaaaaaaatgcccagtgtggttcacgatgccatctgggatgctacttttgatgttgttgagaaagcagagggctatgcagtcaaagaacttcaatccagcgttaagtatggaaatggtgagttagctcgaagtattaaatatgaggttgtcgatagtgatggcaagattgtcggtcgtgtctggtccgatgacccagtagcgctatttcgtgagctcggtactggacgagtgggtgaggagtcgcaaaaagatttacccgatggatttacaccagtgtacaggcaaacgccttggttcattcctgctgatgacgttgatactgacctgagtgaactgtatggtatgcctaaaatcgaaatcgacggacacacattctatcggacaagcggtcaacccgcccgccagtttttaacccccgccgtcaaacaagccagtcgtgaggcaccagagatgattaagcagagtgtggaggccgcactccataacaaattagggggtagttgatggtaattattaatgtgaagtcagtagtgtatcaagcactaacggctataccggaaattaaacaggtctcaaccacgtacccagataatttaacggtgttcccaatcgctgtatacaacacggcacataaagcctattttcgtgatgctaatcagcaggagttgcaaacggaatggacgatcacaattgacctcttcttaaaagaaggtagcacaacggcaatcacgaataagctcatgtcatcatttggtgatatgggcttttcaagcgatgttggtgatagcaatttagcgggtgtgaatcgcactgtattacgatttactggtgttgttgataacactagtcaccgcgtatttgaaagttgaaaggatgattgaaattgaaaaagaatttaacagtatttgatttacaacgatttgctgcagacgctagtgccgggcttgccggaacagggaccaagcttgaaatgtcagtggatggcactaagtttgatgaaattggcggtattaagaccgttcctgacatgggttcagacccagaaaatattgatgtgactgatttatcagatacgaaaaagaagtcagttcctgggattgaaaatacatcaacgttagcttttacctttgtgtacaagggcagcaactttgcaacggctttaacgcacaatggtgacaataagcaatataaatggaaggtcacttatcctgatgggatgacagcttctttcactggctcatataccgtcaaaatgggtaacgttgctgtcaacggagcacttgaatacacgatttcgattatcgtatcggacggaccggactttgcaacggccagtagtagcgccggagcttagaaccgtcacattttatccagataataattaacttgagtaagagacgagtaggccagcaggctgatatgagacgaataataaaaatggaggaactacgttatgacagtaaagaaagcaactaagaagtttgaaatgggtggattacaacttgaattaaagttaacaggccgtgatattttgaatattgaaaaacgcttgggtaaatctatgatgtcgctctttatgagtgcggatggcggaatgaaattgccaccattgaatgaaatgcttatcgtattgcaaggttcgaaccaaactcacggcgttactgataacgacatttttgctgcctttgaaaaatattttgatgaaggtcatgccccaatggatttatttacagtgctaacagacttattccaggaatctggttttttcggcaagacagcttcggcttcgaagacgaatacggaatcggaagtcactctggacaacgaaccaacgaccgagacgacactttaagcaataattaccagactgtttctgagttgctaagtgctatttacccattggccgtgcaatctgggattgattctgaccacttttgggaacttgattttggtgaactcatggttcaagtaatcgcaaataatcgtaaccgtatagatgatatgcgaatgagagcggtaatggatcacaagcaagctgagatgatggcatttgctttgaacgaccctagcaaaatgccatcggttgaagaggcttatccatttatcaaaacagcgactagtacatcgtcggattctgttcctgaatggaaacgggaccagttgcttctaatgcagcaatcgcaaaagattaagacagcccgaaaattcaaaaaaactacatagaaagggggaaacaacgtggaacttgaagaaattgaactgctattcaaagtgaacactgaacaaatggaacaacaatttgccaaggttcaaccgatgattgataaattgatggggaagaccgctgatagtgcgaggtccggtatggacaagaccgagcagtcgatggatgtttctaaaggtgttcaaaagttgcaagaccagttgtccggtttgaacgagactatcaaaactgcattcgaacgaatgagtagctcgacatctaccggggctagcaaggtcaaccagaatgctggcaagatgtttaccggtagccgggttaaggtaaaacaggacttacaggccatgctgagtgatatcaatgcaaagatggatcaggcccgagctgctcaagccaagatgcgtgacttaatgaatcaaaaaacgtccttgaataccgctcaacagaatgggacgcaaggaattaaaattgataatcaggttgcgtccgctcaagctcagatgacgcgttatcaaaaccaagctaaagctctagcccaatcaatgcgacaagaatttaaagcggtgccggactcactgcggcagatttctaaagctatggatcaaaacgaagttaaaattgaaacctatcggcgtcagttgaaggcgttgcagggctcctatcgtgatgttcaggattctatgaagacgatgggtgccagcgaccggctgaccaagcaaagcacggcacttgaaaagagcatcatgagcacacgcgataagatgaacaagctcattaattccaatgatagtctgaataagagctatgcttatgtttctgatcgtggtgacgaacttaaatctgtaattggtaagctcaatactgagatgggtgaatccgggacggctgctacacgagcggcaggttcgtataatcgtttcggcagtgcggcaagtagcgcaatgaataaaggatcaggttccggtaaggggccttctaattggttcagtcgcattagcaacggtattcaaagtgcaacaagtcggatacgcaattttggaaatagtagtagttcttcaatgaacaaagcctcttctagtgctagacggaccagtggggccctgggcggcattgcccagcagttgaagtacctcccatcacaattaatcgtatttgggttgctgtaccaaggcttgacgcaacttgctactgggatgatgacagcatttaagacgaacgcgcagtttacaagtagtctgaatcaaatcaaggtcaatttactgacagcattctatccgatttacaactttgtacttccggctgtcaatgcattaatgtcgtcattatctaaagcgacatcatggttggcacagttcacatcagcactaacgggtatgagctattccaaggcgcggcaaggtgctcagggactttatgagcaatctaaggcactaaatgacacggctgccgcttctagcaaagcttctgcttctgttaagaaggcaaacgaagagattcgaaagcaaaatgcggctcaggctaaatcagttcgtgaagcaaatgctcaaattcgggcgcaaaatcaggctcaagcagcctcagttcgtgaggctaatcgacaaattgcggagtcgaacaaacaaggtgctgccaaagttcgtgctgctaacgcggcaattgaagccgccaataaacgttctcaggcttccatggaagcaaccaagaaaaagaacaaagaactcatgcagtctttaatgggatttgatgagctcaatgtcttggataagagtagcgatgatgaagactattcctacgataaaaagcctaaagagacatttacgccgcaagaaatgcaagctgcgccagagtcaacacccacgcaaagtgcaccagaaagtacaccgttgcagtcgacggatgacattggtagtgaagccggtaatgatggtgttaattttggtgttccgttaggtcagtcattcaatagcgcaacggatgcagcaaaaaagttacaaaaagttttgggtgaactttttgatccaatgaaggcggcgtgggacgccaagggtaagtcggtagtagatgcggctaagtatgcttggaaagaggtcggacgtgcccttggggatgttggtcggtcgtttatgcatgtatgggataacggcactggtcagaagacagttgaggctattttacaattgttagcagacatgcttaatattattggcgatattgccaaagctttctcacaagcatgggaaggtggcggcggtcgtggtactaagctagtccaaaccatttttaattcgctaaataatgtattgaaactgatacatgatattgccacttcattccgtagtgcatggaatggtggcaatctgggcgaacggatttttgccaatctcattacgttggtgacaaatttagtcgggctgattggtgatatcgctaaggcgtttgataatgcatggaatcatggcaacactggtaccaagcttattcaatcaattttaaatgcattgaacgctgtaataaaagtgcttaataatattgcagtagcatttcgtaatgcttggaatagtggtgcgggtgagaaaattgcatcaaatctctacaagatattcacaaacatctttaatactgttagtgcacttggcggccaatttgacacggcttggcaacatggtggcgttggtacatctatttttaaaacgctgctcggtatggttaatgacatgttgggtgcgttaaacgacatgacaggagcaaccgttaagtgggcttctaagcttaatttcacacccttactacaatcgattgatggattgctaaaagcgattagaccagtagtcaaagatgtatgggacggcctggattggggatatcaaaatatcctgttaccattggccaaatacacgattactaatttaatcccaacgttcttcgatgcattagctgcggcgcttaagttgtttcacagcattattcaagcttcacagcccgcatttaaatggatatgggattcgttccttaagccgttagcaaagtggactggtggagttatcgttggcgtgcttaagaagttagtggatgcattgggtggaatttccagttgggtagataaacaccatacggctgttgaagcaatggcgaaagtcttagtaactatgtttgcattcaaagtaacaatgacaggattaagcaatggaataggactactggggaatttagctgataaagcggttattatcggtggtaaagggcatgttctcagagactttttcaaaggtattactggaattgataagttagaagaagccgttggcagtgtgaagacattatggtcgcttgcaaaaatgaagtggtcagattatgctgctgcattagcagatggttggaaggcactcaagagttggtcggtgtggtctaagctggctgctgttggtcaagctgcattgaatgcagttatggatgcgaatccagtagcattagtggtattggctatcgctgcattagttgctggattcgtcgcgctatacaaacataataagaaatttagagatttttgtaattctgtgtggaagaatataaccaaatggtttggagattcaatcgattggatctctaaaaattggactaaaataattggttttattattaatccggttggcacgattgcttcctggttccttaaagatacaaaaacaggtaagaatattcttaaatgggcatcgaaattaccgggtaaagcctccgattgggctaagagtgttggtaaaaaggttgggacccatataactaatgctaagaaggatttccaacaagcaggaaagaatattggtaattggactactgggtttgttggcggtgctaagagaactgttaacacttgggcatcgaatattggcaatggtgttcacaagaaagtctctgatggtaaaaaggctgctcaagaagcgggtaaaaagattggtaactggacgtctgagtttacgagcaaatctaaaggtgcagtcgtcggtattcgaaaatgggcatcaaatattggtagtaatgttaatactaaagttgaagatggcaaacgattagccaagaatgcgggtagtaagttaggttcatgggttaataactttagaactggcgcaagtaagactgtctctagttgggctggaagtttaggctcgaagactagttctggaatggggagttctaggacggctgcgttaagagccggtactcagttaggtaattgggttgcctcgtttagaactggcacgggtaaaacaattgcaaaatgggccggtggtttaggcggtaaaattggtggcggtctttcatctggttggaagtctgtaaaaaagggttctgcggatgttgctaatgcaattattggtacgattggaaaagccgttaatggcgttatcgatggcattaaatggattctcaatcacgtaggtgcctccagcaaagcaaagtcattgagccactggagtgttccttcatttgcaactggtggtcgccataaaggtggtccagcaatcgttaatgatcaggttggtgataagtatcgtgaagcatacaagttaccaaatggacgaacaggtcttttcccagccgttcgcaatatgatggtcaatcttccgagaggtactcaaattctcaatgcggcacaaacggctcgtaaagtaacagcaatggtgccacactatgccggtggtattggagactttgattttgacttttcaagtattggtaacttcaatttgccaagtttcaactttagcatgccgaattttggtgatttgttcagtggtataggggacagtgtaggcagttttgccgatggtgtgaaagatacggcaagtgatatctgggacgatgtcacgcaccctgaaaaagtattgaaagctgctatgaacaagtttgttaaatttaccggcttaggtggctatccgctagatgttgctaaaagtatggtggattttagtgttgatagtgctaaaagttgggtcggtaagattctcaaagaatacggcgagagcgaaggaccaaatggtggtgcaatcactcattcaatgattagtcgcgcactcgagatgactaaagttcctaaatcgcggtggtcaaagatgcaacacgatatcattgaagtggctaagtcagagaccgggaatcgaaatattatgcagacaattactgatgtgaactcgctagctggtaatcctgcaggtggaccactacagtatgtcaagtcaacctttgatgcatttgcttttcctggacatcataatttcagatcatcatttgaccaagtattggcttatctgaataactcagactattacaatgctgccggtcatacagtcatttggggcacgcctaaatttgattggttgcacagtggaccgattgggcaccgccgttttgctaacggtggtcttgttgatactcatcaaatgatcgaagtggctgaacagaataagccggaaatggttttacctttaactaacattccacggtcaatgcaattgattaagcaggcactaagcttcatgggacaaacgttcagtgatggattacaaatgcccgcagctttaactcagtcgatggatatgagcagtctggctagtcagccaagtaatacaagtacacagagtatgaatagtggtggcattaacgagcttggaacaagcatcgttaacgcgattgtacagggcttacaaatgacaaacgttggcggcagcatgaacaatcaaccgatcaatgtgaacttgacgttgcaagttggtgatgagaagttcggtaatgctgctattaaaggcattaacgcggtaaatcagaagaatggtaaaaacatgttgagactataggagatgattacgattgacatattcactgaagattggtgggacagtggttaaagcaccacagtccctagaagttgcaattcaagatatcgatgccaaagcatcgcgtgacgcgaatggacttttgcatcgagaccgtgtcgcaatcaaacgcaagttaacagtaaaatgggggccgctaacactggccgagaatagcacaatactaaaagctgtctctggacagtttttttcttgcagttatttagacccacaagaaggtgcagtagtgaccaagacattttatgttggtgatcggactgcaccgatttatacacttaatccagtgacatcagattatatttggcagaatgtttcaatggatttcattgaacagtaggcgggtgaaaattaatgattaagcaatctgatttagccctcgctgcatggaaggcaactgaacggacgttggatgcagttgtcacaattaacaagattgactataaaacgacagatattgcatccatttcatatgacgcaggtggctatactggagatacgtttggtattggctcgaattatgaaaacagcgtgacaattaagttttcgcacttaattgaaggacttaaacccggcatgacggtatggcctaagattggtataaaaacatctaatggctatgagtatagctcgcttggtctttttatcgtatcagatgacattcaaatggaccgaaacaacgatgagacaacaattaaggcatatgaccagatgtgtctactggagggtacctacacttctaagttaacttaccctgctaaaatgaccagtgtgattgcagaaattgcaaatttggctggcgtgttactcaatacaactgacattagtcgtttgcctgtacaagttaacttaccgagtgctattaccggtcaaacgtatcgaaatgcaattggcatgattgctcaattttatgctggatttgcaacgtttgatagggacggcaaattaacaattcgcacgattacagagccagattatacattagatccgagccaatatgaacaaggtggcttaacaaaaaatgaagcaccatacaaaattggcggtattcagtgtgaggtcacaacgactactacggattcaacaggtcagagtaccgaaactacaaacacgcttcaagtaggggcaacgtcaggatcacagattaaactcaccaacaatttgatgacaatggatcgtttagcatcaatatggcaacagttacaaagcttgaccttctaccctttcagtttgaattggtttggcaatcctgcaatagaagctggcgattggctaacactacaggatactaaaggaaacaagttcaacgtgcctaataatggttatactatgacgtttgatggcagtttgtctgctgtttctaaagcagatcagacctcaacctctagtagtagctatgcttggcgaggcgagctatcacaatatgttgctgacttaggtggacggcaaggtgcttcgggtaactatatctatggtacagatacaactgaaccgccatacggagctaaatttaacgatatctggtacaagcagaacggtaataaagttgaattgtggacttacgagcgtcaggcagatggaactggtaaatgggtacttactgtgtcggacgctactggggaagaagtgaaagcaaaagttgaccaagtggaactggaagctaaggctagtacagatgcagctaaagcggccagtgataaagctgaccagcttgcggccaagtacgatgatacaaatgcattagctaatcaagcactagacaaagctgtaagtgctcaaagtgacgctagtgctgcagttgccacagcaaactctacagcctcggaattcggaaaagttgaccaaaaggcagatagtgccttagctagtgcacttggtgcccaaagtgacgctagtgctgcagtaaaacaggcttcttctgctgccgctgactctaaagatgctaagcaaattgctggagcagttagtcagagttataaaactttaactgatggttcaactatgaccattgctgagttacagaatggcctagctgccaaactgactaagactgatctcaacggatatgccacccagacctggactcaaaatcagattaaaatgactgctgatggaattaacggaaccatgtccagtatcaagagtactgtcgatggtcagacaaccagtatcaatgacctcaaggctgactcaagttcttttaagagtcagtttacaacagttaacaatactctcggtaagcagactactgacattggtaccttgcaagccacgtcaaaagaactgactaccggattcaatacgttaacaacggataatacaactaataagaacaacattagtcaacttcagcagactgccacagaactgaatagcacgatgacgactgttcaaacacaggttcaaaacagtgctgtcgggactaacctattaacaggaactagtggtgacttaaaaacaaaacagctaactaatatgtataatgcaggcgctcaagcaactaatggagattacaaaatcaaattagttaaggggcagacgtatacgtaccgagcatggattgacaatactaatggccagactcacgcatatgtgaacgcacgttttttagctactacagagtataatttaggcaacggcacgcctattgacaaaggtgaagctggatactcgactttaatgattaaacctaccgaagatgggtatgtacatttgacgcctgttgcgtatagttcaccgcaaactaatttaattgggtggaaagaagaaaagctggaaaaaggtagtttatctactgattggtgccctaatccagctgataatgctacagttactgctttatccaagctttctcaaactgttgacggtatgaaagctgatatttccaagaagattgagaagaaagaccttaacggttacgctactgaaacttgggcgcaaaatcagattaatattagtgctaatgggattaatggcacgatatccagtgtcaagagtacggttgatggccatacaaccagtatcaataacctccaagctgattcaaatgggtttaaagctcaatttacgacagtcaataacactatcggtaagcacactaccgatattggtacgctccaggcatccactaagtctttgtctgctagctttgattctctgagcaccgacaataacattaataagcatgatattagtcaattgcaagcgagtgctacagcatttaatagcactttgttgactgttcagcaacaggtgatagatagtgctgtgggaactaacctgttattgaaaacctataacccattcattatgacgggtaatggtggggttaaccaggcgacactaatgtacgcactaagcagaagactcgaaaaaggaacgacagtaactctaagttttgatgccatttctacggcttctgcgaactttacaatccaaaatagtgctagcggagacggtgggacttggatgggctaccttaataatgcggccgttggtaccacaaagaagcattatgtagcaacaatcaagttagatggctattcacagcaaggtgcttatctccgcttagataatgtgccttcgacagctactattacattctccaatatgaaattagagctaggttcaaatgctacggactattccaccaatccattggacaacgcaacagttgatgcagtttcaagtatctctcaaactattaacagcatccaaacgactgttagtggaaaagttgatggcagtacctatcagtccaaggtagatcaattaagtaaccagataacttctgttgtagggcaggtcaatacctttggttcaagaaatattgtgactaactcacagttccaatacgactatctaagcggaccatcttggactacaactggtgcgactactgatatgtggtacaaatcagattttgcttggtcatgggttaatgggtatcaaggtatttgcttcaatcaaccaacgacgactgacaatagtgtctggtatgctttgcactctagaagaattgttattggacaagatatctcgactccttggtcggctagtgcttatgtgaatatcgataccgttggcctcgctgcggtaattactattgaattttacgacactaagggtaatcatattgggcttaaggaaacgtataaaaccagccgtggaatggaactaattaaagttgaaaatgctgttcctccggctggaactgaaacagtttgccttgcattccaagttcatggtggtggccatgttgctatgatatgcccaatgctcaaccaaggaaccactgctgctacctatgttcctgatgttacaactggcgaagaccttcagcatgcatattctgctatcaatcaaactaatgaccggatcaatcttcgtgttgaaaaggccggggttattaacgcaattaatatctcgactgaaggaatccagatatacggtaacaagctgcatattacggctactacctatattgatgatgcagtaattaagaattccatgattgagaacctaagtgccgataaaatcactgcaggtactattaatgctgcgcatataaacgtaatcaatttgaatgcgaataatataacgaccggtacgattaacggtagtaacttatcgattaatctgaatactggtaatgtcgagttccagaaaggacgtatccattcgtctgataatgcgattgatattaacattaacagcaagtatatgtcagtcgctgacaaggataaccgtatactcatatctggtggggaaatccaaatgatccaaccgcaatttttcgaccgtcaaactagcccgtatgttcgtatcagtaatgctcaggcaggggcatcttggggtggtgcaactttctggggacgtgactattttgtggtcactaacggagctaacgatggaagtatcttttcttcgccactgggagaagaaaagttcgcaggcatttctggagggcactcgacctccggatggcaagtaaccaagatcggcggtgccgaacggggtgtgattatatctgggggtagagaatataataatggctacattagctattcgccatttataagagttggtgatcctggtcatgcagggacgggtctacatggtaagaacatcactgtgatggccgattacatttatctaaactctcctcattcaacatctcatggtgcgaacgcatatttggcccccgatggggcattagttccatcgaattccgctgctaagtacaagaccgatattgttcgaacatttgaaacccagctaggtgataaacttctagaagttccagttgcacattggaaagacaaggaagaggtattaaccaagacccttgaccctgatgctaaaactccagaaacttactttggaatgattgctgacgatctggatgatgctggcctgaatgaactggttgaatacgatgataaagggagcgtccggggtatccaatatgaccgggtcgcattagctcttattccattgatccgtaactatcgggatcgtataactgaattagaaactgaagtcaaagaaatgaaagaggtatagtcaattatgacagcaagaaaagaagtattaacattcacaaacggacaactggtagccattggaaacactttgtcagaattcaggcttaaaggtcgagcttcgcttgggcgcacctggttgattaatcatcttgaagaactaaacaagcaatttaatgctgaccaattagcaactcaaaagactttctttaaaacagataaagatggggattttgtttataagaaagacaaaaagaccctaattctgaaagacgactacaccatggacgaagctcaaaaagagtttgaccaattagtgaacgaaccagtaagtattgaaatcagctcatattctgcacgaatgaaagctttatttcatgcacttgaggactatccatacgagctggaagggcaaacagctttagtatacgcattggtattcgatcagtttgataaagcatatggaaaaggggaataaaaatggaactattaaacactagcatctcttataatatcgatggaactggaaatacgagttctgtaattgcaggtcttcgtggcgaagtagaaggtcgagtaactattacggcaaatgtcactatttatccgacagacttagctaaagatgaaactttcgatgatctaacaaaaaaagaattatccaaacgtgcgatgaataagattccatcaataattgactctctaattgcagttaatggtgggtggagttttactgctggcaggatttcatctgtatccactcaatttaatcagtctgaaactggcacatatgtgaatgcgaatgttactgccactgaatcagatttttcagataagaagttagacgatgttacaatgtcggaggcgcagagcgtgctgcaatccattcttaagaatgaattgccaacatcataaatattaagtgaaagatgaactttgaagagatggtgaattgaaaattaataagttaaaacgactaggccagtgtattttaggatgcttttgaccgttcaatcaggaatgacaaataggaggtagacaattgaataaacgtaaattaaaggcactcatcttaatgatgggcgccatttttatggcctttttaatgatcaacgttaccagtcaggctgctcgtatggatatggtcgatgtgtctaataacaacggctacatgtcaacgacagagtatgtttcgatgcgtaatgaatttggtgttaaggcccttaccgtaaagattagtgaaggtacaaccttcaaagatggctatgctgctagcaatatcgctaatggtcaagcagctggcttatacgtcaacggctatcactttgcccattataaaactaaggctcaagcaattgccgaagctgactttgctggtcaggcagccaaagcggccagactaccagtgggcgcagtattggcaacggacgtagaatcggctgaggaacaaggaatcttgtcacaagcggccaacgaccgcaacaatgctgccttcatgaaagagattcagaagtttggttatcgggccgacatttatacgtctggatcatgggctaacaacaagatgaccatcaagggcaaaacaggttgggttgctggttacccctatgtcatgtctggtcagaagtggtatacgaataacaatgcctggcaatggtccggggcagctcgtttccggattagctacggtggctttgacgtcagtcaactttatactgattactacacagctggtcagaaatcaactgtcaagccaaccgatccagatgcggttaaagataacaataaaaaagttaacaagccgtacactgctgccaagtgggtcaatgaaaagaagacatacacactcaagactgcggttaagttgcgcgcaggtgtttcaacgttatcaagcgctattgcaattttaccagctggaacaacagtcaagaccgacaaagctatcattaaaggcggctatcgctgggtacgccaaccacgttttaatggttatggatatctagtaaccggcccggcaagcaatacgcttgaatatgtcaagagtggtgcaactcatacgtattacacagttaagtccggcgacagctggtggacaatcgcacaacgcaacggcctgagcatgactacattagctagccagaatggcaagacgatttacaccactatctatcctggccagcgattggtggtgcggtaattgcatacactattaggattaggttgggatgaatggggatcgattgttgccattgtcactagtatttgtgtattagctaatgggattctcaataagacggtccgtatcccgcttaacgatttaggcaagcggctgagccattttaccgatgaaagtttaaaagtgagacagcaaaatgccgacacaatgaacgcgattgaaaatcgggtcattaaggtagaaggccggttagatggccatgacattgaatttaaacatctatatgaaaaggaagccaaaggaaatgaaaaaaattagttttaagaatgctgacggaagcttgaatggtaagttgattgctgggattatttctttgctgattgttttaattcaacaaatctttgccatgtttggtattaagtttactggtgattggtcagccattgttgccgttattaacacagtgctaacaatccttggtatgctgggagtggttactgacgttcaaacagttacggcaccaacgattaaaagtgacgaggaaagccaagtcgaagcagcagctaataaggttgctgacgaagcaccaacaccaacgtcaacggtcgctgcagtgaatagttctgcagcttctgacactgaaacggcgtcagaatccgcttcacaagcagcaaaatagtgctataataattgttggctataacttgatatatagtttcattgtggagcttgatcactctgcaacttttcccctgcgcttcggcgtgggggattttttatgtaaaaagccgcctgctgtaaaggcagacggctaatacataagagaaagtatcttagcgaaagagggaaccagattattactaggttccattattatcataggaatagatgagaaatcgtgcaactttaatactcactactgtgaaactacattgctggcaattggcaggtggtattcgaaagctggttattctcacacgtattacatggtcttttcgggtgatagctggtgggtaattgcgcaacggaacggtctgaacgtatatacgctagctactcaaaacggcaaaacaatctattcaacgatttatctgggtgagcgactagccttaaagtaataggtcgttctatatgacgtacagagaataatgatttatattgtttgtttccccgtttaatgatatcctttttttaggaggtgtgaatatgacgagtaaactgtatgatcccatggatattgctaattatttagttgtattggcaaaagaaaatggaaaaacaattacgaatctcaagttacaaaagattttgtatttcgtgaatgcaaaataccttgttgacaatcaaggaactcctcttatgaaagaaaagtttcagagatgggcatatgggcctgttatgtataatgtttattctagttttcgtgatcgtggtgcggatcccattgaagaaacagtcggtacttttgaacttaatcaaactaatccttttgcgtcaaagttcaaaccttttaatgaaaatgagatagatgacggagttaagtcaattacaaaatccgtgtttcgttcattgattgatgttaatcctttcgatttagtgaaatttacacacgaagaatctttgtggtctgattatgaaaaacaaattgatgagcgagatgctccagattatactgacgatgagatttataaatattttaaagaaaatcctaccaaacgcatttgggagcacaagcaatgagtgatgtgtctgaagatgaattgttatcgcgcatgcttattagtatgagtacacgttcaatagacgataacgatgtgcaaaattttattaatattattcataatggtacttttcatgtgcgtcacgcgaagattgctaaagtgatttatgctgtcggcgatgaaggaatagacaatttaaataaaagttgtcaaactattgagacggcaccggcatatgataaaagtacggaaaaacttatctctagcattaggctgtctatggtgcaaagagactttattcttaaaaatataaaaaatgctggtattgaagccgaaaagattaaagacactaagtctcaaatttatacagacattatatctgttcttggtattttttctgctttgatttttgcactgttcgggggcctcagccttctatcttcgatttctaatttagttaagggagttaggctgagtagaattgtgttgcttacatctggtgtttcgttagcattaatagtattaatctttttgttactaaacggaataagcggtatggttggaaaaaatatgaaggtatgttgccataaggataattgtgtgcatactttgtttgaaaaataccccttcttcgttattggagttagttgttgttttataatgatggttgtcagtgttattgtattgttgattgataatagtggtgttttgtatgatcatccatatataacagttactatgattttgatatttacattgatagccgcatatcttttttacaggctgtcacataagcacaaagaagcataaaagatccccacactagcaattgctggtgtgggacttttttatgtttaagataataagttggtatataatagtgaagaaagcaaaacatcaaaaaaaggaccaatattaaattaatttgtgctcttccacgatttgtaaataaaatatctctctttttcgcaaagggcttaataccaatggtttgttacgtgctacctatgatggtataactaccgtgcgggtgataagtcgacgtcggtagataaaaagagaagcgtcataatgctggtatatcagcattatgacgcttctcttttgctaattggtatcaaattaaaaccccaattttgcgttttggctgttgtgatcacaacagcactgttaagcgctcataaaaaagggttttgggatcgtgtcacaaataagggtcctatgaattaattattactcgttaatagtgtctgaaaggccgttagcgacattccaggtacgacccgttgtcgagtgagattgtatgggttctgtgtgctggtggcgatgccaggtgccgttgatagggcatactgatagccagcctgtttatcggctttaatggtctgctgattagcacggccggctgggtaacaaataacttgtgtgttctgttgtaaattatgatcgagccattttttggaacttgataattccgtaagttgaacctggtaagttaaattatttaaatccagatggcgaacggtgtgactttgaaaatcaatattaccggatgcttgcatccgcttagcatcagctaaagttaagtggtttttcttatgggtaaagccggtaataaaattaatggtggcgtgttggtgcgtctgtttcaaaattggccaagctgctgtcatgttatctttatagctatcgtcgagtgtgatccagacaatcttcttttgtggaattcgccgatgtttgagcgcgtatacggcttcattggcagtcagcgttcggtagccgtgtgcctttagataagtcatttcagtttgaaattctttggcggggacacgtaactggttcccgctagaaatactgtgatacatcaaaataggcaagtgaacatctttgacggtatgccaatgttgataaggccgtgcttgtgcttggtgtttagccgagctgtgaacgcttttagcgctagtcttagatgattgactgctggcttgtttagttgccggtgaagccgcctgacagcctgctaacaggccgagcgcgacgccgagacctaatacaaagttgataccccgcatgtgcatgataaatccccccatgatttaaaaactacttcctattctaatagaatagcatgcaaagcgcgataattattgaattattgttaaaataatttccttaatgtttaaggaaaatcgaatttgattagtaatcgtttaaactgattaagaaagcctagttagggtagccagaggagctttactccgatacgattaataaaataattaattcgggggatagtatttatgaataaaaaaagggctatttggttggcggcgattattatgatgattagtgtaggtacattgttaattgtaccgacgatgacgaagaatcaggggagtgagctggcaatggcggtggataacttaaacccatttgttaaggtacaaacggtctatggtcggactaatcaggcaatcggccactcgactggtcagatgggcgaagatatctatacctatcgaatgctgaccagcgatgcgcaaggtaagcaacgctggttgacatttaccgcagatcaccggctaaagcaacgacactatttaaagattgagacgaagggacaaaacgtgaattcatgggaggccgttgcgacaaatcaggtacctcaaaatatacaagaagtattggcttaaatttaggcatagtgccgtgtcagcgattagtgacgcagcactttttttgtgttattacgaaggcgagcttaataaattcttaaatccttttgagtgctaaactgcgatgagtgcgttacaatattttacgtgagacttgtaaagatggttgacaaaaggaccatttttagttagattaagatactgcattattatgtaataatgaatgaaggggagcgtgcaaatgcttaaaatagcaaagggtcggatttcgtatcccgcggtaatcggtgcggtcttatttatgatcgtgcaagtgattgcgaccttaaatctgcctagtttgacatctaatattgtgaataacggggtggctactggtgacattagttatatctggaaaatcggatttgaaatgattggtttttcattgttatcagtcgtcgcagcgtttggcaacgtctttttggcggcgcggtcatcacaacaattagggaagaatttacggtcggatatttataagaaggtcatcaacttttcaaatgatgaatttgataaagttgagacgtcttcactaatcactcgaacgaccaatgacgtcgtccagattcaaaacgtggccatgatggcgttacgaatgatgattatggcgccaatcatgctgattggtgcaagctttttagcgtataccaagagtcatgaattaacttggatcttcgtggtttctattccggtactattgatttttattggtttgatcatggcgtttgcaataccgttgtttcgggcgatgcaaactaagactgaccgcatcaaccttgtttttcgtgaaggcttaacgggagtacgtgttattcgagcattccgtcaagataaatttgaacaggaccgttttgaagacgctaaccaagattacacgcacaatgcgattaaggttaatacgattgtggccttggcttatccggtaatgactttgattatgagtgggactaatgtggcaattgtctggtttggtggccaattgattagtagtcaaacaatgcaagttgggaacatgattgcgtttatgacttatgccatgcaagtattgatgagtttcatgatgcttgccatggtatttgcgttcatcccacgggcggccgcttccgcttcccggattcaagaagtcttgagtattgaacctaaaattactgaccctgacaaggcagcaacgttaccagcgacgactgaacacagcttagaatttgatcatgtcaactatcggtatcaaagtgcggagcaattagcgctggcagatattgactttaaagcccattctggacagaccgttgccattattggtgggaccggttctgggaagaccacgctcgttaatttaatccctcgattctatgatattgagagtggggcggtcaaattagatgggaaagatgttcggcagttgaagttagctgatttacatcaagccgtttcgtttgtcccgcaaactgctactttattcacggggacgattcgtgaaaatatgcaattcggtaacgaacacgcgaccgatgatgaaatctggcatgcgttagaaattgctcgttcaactgacttcgttaaagaagaaggcggcctggatgcacacgttgaacaaggtgggggtaacttctctggtggtcaacggcaacgattagcaattgctcgtgcacttgtcaaacaggcttccgcttatgtatttgatgattctttctccgcattggacttcaagactgatgctcaattacgggctgaattacgccaggataaacagattcaacagagtgtcgtagttatcgtggcgcaacgaattgcgacggtggcggatgctgatctgatcttggtcctagataacggtaagttagtcggcaaggggacccacgctgaattgaaagctaataatgaagtttatcaagaaattatgaagtcacaattacgagaggaggatcagctgtaatgagcgaaaagaatacgagttctactaagcctgcacgtcctgctggcggtcatggccccggtggtcatgctggactagttgaaaagcctaagagtttttggaaaacggcgattcgattgatgcgctacatgtcagaccggtgggtcggtttggcagtggtcatgatttttgccattgcttccgtgattttccagattcgaacacctaagattttaggtaaagcaacgaccgaactttataagggaattatgaagggggccgcgcaacagaaggctggtatcagtcaatccggttacccaatcaactttgaaaaaatcggtcagattattatgatcgttttgatcatgtacttggcctcagcactgttcaactttattcaacagtacattatgacgcggatttcccaacggaccgtgtataagttgcggcgttcatttaagggtaagatgcaaaaggtgccgatttcatattatgatacccattcgaatggggacattatgagtcgggccgtcaatgatatggataatattgccaacacgttgcagcaaaacctaacccaagcggtgacaagtaccgtcacctttgttggaaccttatggatgatgctgacgattagttggaagctgaccttgattgcactcgttaccattccactgagtgtcgtggtggttggtgtgattgcgccgaaatcacagaaattcttcggaacacagcaaaagagcttggggttgttgaataaccaagttgaagaaaactatgctggacacgtggtcatcaagagctttaacaaggaacaagatgccatcgatgattttgaaatccaaaacaataattattatcaatcagcctggaaagcgcaatttatttcaggtattatcatgccactgatgatgttcttaaataatattggctacgtctttgttgccatcattggtgggattgatgtggctaacgggaacgtttcgttaggtaacattcaagcgttcttacaatacacgcaacaattttcacaaccgatttcacaaatggcgaacttgttgaacacgattcaatcgaccgtggcttccgctgaacgggtctttgaagtgcttgatgaagaagaaatgaaacagacgaaatccaacttaccagccgaaccagatagtgataacttgattagtctgcaacacgttcaatttggttatgcggataacgacctgttaatgaaggattataatctggacgttaaacgtgggcaacaagtggccatcgttgggccaactggtgctggtaagacgaccatcattaatttgttggaacgtttttatgacatcaaaggtggttctattaaattgaaagggaccgatacacgggacctggatcgtgaagacttgcggtcacactttgcgatggtgcttcaagatacctggctctttactgggacgatttttgacaacttgaagtacggccgtgaagatgcgtcagatgaagagatttatgctgcggctaaagcggcccatgttgatagctttgttcgcaaattgccagatggttatcagacggttctgaacgaagaagcttcaaatatttcacagggacaacgccaattattgacgattgcccgggcgtttgtggctaatccagaaattctgattttggatgaagcaacgagttcggttgatacgcggactgaagtgcatattcagcatgccatggaacgactcctgaagaaccggaccagttttgtggttgcgcaccggttatcaacgattcagggtgcggacaacattattgtgatgaaccatgggtcagtggttgaaactgggacgcatgaacagttgatggctcaaaatgggttctatgcggatctatataacagtcaatttactggcaatattagtctcgactaaaggaggggtgtcaattgttccggaaaacagcaatggttgccgttactgcgggtgcgctaacgttcttattagcgggctgtggtaagacaaccttatcaacgactaaaaccacatacaagccgaacgggttagtagcggccgtcaaaggaaaatccaacgttaaaaaggttcattatcagcttgacggtggtcagacgaagacggcgacggtgcgtaatcatacgtttgttattcaagttccgaccaagacgacccgccaaacggtgaagattaaggccggttcggataccacgacggtgcacgtaaagggcgccaagaagctagttggctatcaaaagatggcgacgacttacaatcaggctttgattgcttctaaactcagcaagtctgatcaacaggcggctaagaagttgcaaactgagggtgcagcccttaaaaagcaacaagcaacgatccaagccaaagtcaagcaagcccaggcccaaatcaaggctggcggtacggcggctgccacgggtgctaagacactccaggcccaacaaactgctgcggcgcagctcaagaccaaagcagctagtttgcaaacgactcagaagcaggtcgaagcggcaatggcaacggcgaaaaagcaggtcaagtcgcaattgttaccgacgaagatgccaagtgatggcattaagaacgtgttaacaactaaggattataagatccggctaaatgttcagaagggtgacgtattaggggcagcgatgattgttccaaccaaggcctttaagaacaagacccgccagaagaactttgggacggcgtttgctttgatgacgacaacaacgggcgccaatgccaagaaggttatgaaacagttccagaaggaaaccaaggataatagtggtagtacgacgacaatcgatccgattacctctaagggcgttcgcttcacgattggtgtctccacgtctgacttgtatatctttatgactaagtaacgttttatgagcgcgactggactttgattagtcaagtaaagctcactattcgaggttatgacgggacgaacccgtagttctaagtcggctgcattttacgcttgtaaagtaattaaaaaatcaccacctggatgaacataatccaggtggtgattttttgattgttaaatttgattccaaatagatcgtaaaggttacgtgcgttaaattactcaaatgataactctaagaagtataagtgtttggctggtaaatgggccgaagaaacccatacttcatggtagttagggacctttttctctgtgtaatcgaagaagaagtcaagtaagttgccgtttttagcgacaaagtcatcctgaaatcggttgactaatagcttgttgtcaggaaaataaatttcggggttagcgaccttaatatgatcggggacacccatccgaacgacattcgtgtattccggttgggtaaactgaatttcagtcgggtgatgggtgatataaaacatgacgttataaattgaatctgaattactagccacgacaaaccagtcctttgctaaatttacactcattataccaaaaaaatcttaaagcgttggaaatgtttaacgggcccttgacaaacttctaattaaccattaatcttttaattaaattcaaattaattaatttggaaaattacatataaaggaagtcgaagcatatggcagacgtacaattagactggaacaacttggggtttgaatatcggaatcttccgtaccgttatcgtgcgtattggaaagatggtgcttggtacaaaaaagaattaacgggagatgcaactttacatattagtgaaggctcaacagcattacactatggtcaacaagactttgaaggcttaaaagcttaccgcactaaagatggtagtgttcaattattccggccagatcgtaatgcagcccgaatgcagaccagctgtgaacggttattaatgccacaagtgccgacagacatgtttgtggacgctgttaaacaggttgttaaggctaatcaagattacgtgccaccgtatggaactggtgcgactttatacttacggccattgatgatcggggttgggggtaacattggtgttcatccagctcaggaatacatcttcacggtctttgccatgccagttggtagttatttcaaaggcgggatgacgccaaccaactttacgacgtccgaatatgatcgtgcggcccataaaggaaccggggcttataaagttggtgggaattatgcggctagcttattcccaggtcaagaagctcatgccaacggtttctccgactgtgtttatcttgacccggttgaacatcgtaagattgaagaagtaggttcagcgaacttcttcgggattactaaggatggcacttttgtgacacccaagtcaccatcaattctaccttccgttacgaaatattcattactctacttggcagaacataaatttgggatgaagactgaacaaggcgacgtctacattgatgatttagaccggtttgctgaagctggggcttgtgggacagctgcggttatttcaccaatcggtggcttggaacatcaaggcaagttacacgtgttctacagtgaaacggaagttggtccggtaacgaaaaaattatatgatgaattaactggaattcaatttggcgatcgggaagcgcctgaaggttgggtccagaaagttgaattagactaagtacagtgttgtttgtgtgaataaaaagacggctttagtaagacccgtgatacgggtggaactaaagtcgtttttatgtgcgtgcgcatgatgcacgtggtattgtgaatagtaagaaatgctgtctaatcagtagacgcatgatcggaacgacagttattcggctaaggggacgttacggttaggttaagattgctgattgtgatgtaaagttgctgaagaaacgctaaaattaaagggagttgggcaagatgataaagtggagtaatcgacattggcaggcagttgaatgggtcagcacgggaattttggtgggctgtacgttactgtataatcatcaggttgtctcgaatcaatggcttctcgtcattggcggggccgctttaatcagttattggttggtcacattaccgcggttgttcggaagtcagcactagcttcgggcaggtcgttgatgcaatcaggtcagttcgtatccgtagaaattgtcagggtaaaacgtggacagtttgccaggttacttggttgatactgaccttgaaggtggtttagccacagtcaatcccaacttgaatcatgatcctaataagagagaatgaataaattaatgttaacttttagtagaaccgcagcactaattaaccaaatggtccaagatcaagtgatcccaggggcgagttatgccttgattgatggggctgagtggcacacgaatcaagtgggcgtcgctcaaataaaaccaacgatcaaaccattatggccggatgcgatgtatgatttagcctcggttactaaggtcgtgggaacaacaaccgtggcgatgcagttgatgcaaaatgggcaacttgaaattgaccgccccgtgcatgactacctaccggctttacagtccacaacgattacggttcgtaatttgatgacccatacaagtgggctgagtggttatattccaaatcggaatgcgttgtcagcggatgcgttattagccgcgattcagcagctaccaatcagtgagcgtaaccgcaatcatcgggtggtttatacggatttaggcttgatcatcatggggcaagtcattgaacgaattcttggagcggccattcagccaattatcactgagcgcgtcttgcagccattagggttggcacacacgagttttcaacctcaactagcgcaaaccgttccgacgacgtattctgtgaaaactgggttgttgcgggggatcgttcatgatcctaaggccagagccttaggtgaacactgtggttccgccggtttatttgccagtgtgacagaccttgttcggttttcgcaactgatgcttggccaaatcgacgtaccagctgtgctatcacaggccacgattgcaagcttgtatcaagattggacgcccaatcaacacttacgccggagctttggttggaacctctggcaccgttctaatgagacgctgccggtgatttttcatactggttatactggcacgctcctgatgcttgaccgtcaacggcaacggggccttgttttcttatccaaccgggtgcatccagttgcaaataattcggtattccttccagcacgtcgccggttaattgcggcttggttggcggatacggttacaaattagctacttcggtttcacaaccgctttcatttatgctaaaatttagatattaaattcaacaatggagtgagtagatcttatgagtgagccatactttttaaagccggtgttccatgaaaaaatttggggcggtaccaaattacatgatgattttaattatgatattcccagtgatcatactggtgaatgttgggctatttcagctcatccgcatggtccagcgaccgttgaaaatgggccgtacgctggcatgacactggatcgagtatgggcagaacatcgtgatgtgttcggtgatgctaagggagatgtcttcccactattaacgaaaatcttggatgctagtgaagatttgtcggtgcaagtgcatcctgatgatgcgtacgcggctgaacacgagcacgaacttggcaagactgaatgctggtacgtgattgcggctgaaccgggtgcaacgatgatttatggtcatcatgcgaagacccgtgaacagctcgctgaatggatcaacaacggtgaatggaataagctattacggcgagtgcccgttaagcccggcgatttcctttatgtcccatctggaacgattcacgccgttggtaagggaattatggtgttagaaacgcagcagagttctgatacgacttaccggctatatgattgggaccgggtcgacaagaccactggtcagaagcgcgagctgcatttgcaacaatccattgatacaactaacgttccgcatcatgaccctgatcttgacatcacgactacccaggttggggatgcaacggtgaccaaatacgtccaatcaccattctttggtgtttggcaatggcggctaacaaatgggcaagcaacttttaaccggggaacagcaccttatacgttagtctctgtacttgatggtgaaggtagcattgtcgttgacggtcaagactatccattgagtaagggcgtccactttatcttgccatttgacgtaaaacaatggacattgaaaggcgatttacaaattattgcttcagaacctggggctaaggcataattagttaaccccttgatgggataaaaaagattgatactggttggaagccaatatcaatctttttttgtgcatctactgatagtatcagtttattaataatcactatctgaaagtatataaatatttattatagcttgaaggggtttactaatgagaaggcttctaaaaaaatattatcattgtaaccaattaatacggatcaaactaaaaaaatcgtcactggctggtaactaagtcagtggcgattttgagtgatacgttttaaggtttcacgatgacgtttttagtgaggtcttcgttgagttgatccagtgcatcgaagttgccttcagggtacttacgttgtaaggccagtttcaagattcgtttggcgagggcttcattgcgtgcaaggattggaccatggaagtaagacccaaaggtgttcttgtagataacgccctcagattgatctttgccattattgccgttaccttggagcacttgaccaaggggccgttcaccttcgcccaggaaggtcatcccgttgtggttttcaaaaccatagtaggtctggtgggtttcggcgttctcaatggttatattaccaataaagcgattgttatcctgactgagcgtgtaatgatctaaggcaccgatacccgcgatcttttcaccatgggccccaatgtagtaatggcccagcatttgaaagccaccacagattgctaataatgggccaccggcttcgatatatgcggtcaaggcgtcttttttcgtttgtaaatccttggaaacaatcgtttgctcgtaatcctgaccaccgccgaagagggcgaagtcatatttttcttcgtcaaaccgatcatccaagctaactaagtcaacagtgatgtcggcatccactgctttagcatagtagcgcattgctaaaatgttaccgatatcaccatacgtgttcattagatcgccgtagaggtgtgcggcgtgtagtgtataagtcatggttaagccatccccccatcgataatgccttggctagcaagttgttttcgtaattgcaacatcgcggtgtaagttgcgacgacgtagacttgcttggtcggtagtttttgaattgcggtcgtcatgttggtcaggtcaggaataatggttaactgatcttccggtacgccagcaacttttagccggaacgtgatatcacgataacgttcaccgccactaatataggcgggaatattcaatgccggtaatttttcaaaattaccatcccagatccaactagtatcaataccatctgcatagtttgcgttgagcagagcggcaaatgagaatggccggtcatcggtgctgattgtttgcaagacttggttaaggcccactggattcttgacgagaatcagcgtgacgtccttttcgccaacgtgaaaggtctcttgacgaccaaagacttgttcatcgttgtcgctaagggcgtgcgcgattttggccggcgtgacgtccatgaagcgcccaaccgcgtaggcagctagcgcattataaatattgtattgaccaccgatattaagatgcatggcctgaccgttgatttcaaagtctgagctagtcggtgtcatagcggttagggcgtttaatttgtatgtcaactgtggacgctcaaaaccgcagtggggacaataatacttgcccatattgctataagttcgactatggtaacgcaaaatatgctgacaacgcggacaaagcaggccatccgtatttgctggcgcttgttggtcatggtcgggctggtagtcaaatccgtaatacagtatcggattaggcaattgtttggcattgaagagtggcaaatcaccgttggcaataattgtcgcttcaggtgctaaagcaaccccgtctaagattttttgatatgtcgtgtagatttcaccatatcgatccatctggtcacggaaaatgttcgtgaagacaaaggcttttggtgtgatgtacttggtgaccatgattacgttagcttcgtcgacttctagaactgcgagtggcttttggtgcgctttaggtgcccgtaaaaaggtcgtgacgataccttgcttcatgttggatccgcttggattggttaaaatgtcagggtactgttcacgtaaaaccttgaccgtcaaggcggtcgttaacgttttaccgttggtcccagtgatgacgatgacgtcgtagtttttagcgagatgctttaaaatcgttggatcgagcttcagcgctaacttgccggggagtgagctcccaccgccacggaaggtgtgtaaaaaccaatatgcggatttacccgtccaggtggctaatgtactattaattgacataagttatcggtacccctaattcttgatttacctgggaaatgatcagtgtgaccaactaccgggtattaaaatcataattaccggacaaaatgtcctactctcaagtattttatactgaacgtccctaaaagaaaagtgatactcccgccatttaaccgcatattatcaattcgttaattagttttaatgacagaatgctgaaattcacggccaaatccgctataattgactagaaatgtgtaaaaaaggggaatgagtcgcttggcacagttattttttcgatatggcgcgatgaacagtggtaaaaccattgaaattttgaaagttgcccataactatgaggaacaagataagtcggtcattatcttaacgagtggcttagataatcgtgatggtgtgggctatgttgcgagtcgcattggccttaaacgtgaagcaacgccagtatttgatgataccaatatttttgagatcgttaaacaaacgaatccggatgctgcgtgcgttttaatcgacgaagcccaatttttgaaaaagcatcacgtcctagaattggctgacattgttgatgagctaaagattccagtaatgacgtttggtttaaagaatgattttcgtaacgaattgtttgaaggtagcaagtacctactgctatatgcggacaagatcgaagaaatgaagacaatctgctggttctgtcgtaaaaaagcaattatgaatttacggttccacgatggtcagcccgtttatgaaggcgaacaagttcaaatcgggggtaatgaggcgtactacccagtttgtcgtcatcattatttttacccgccgaaattaacaaagtgaggattaactgagaatggataagttttttgataagttacaagccgttgccgatcggtatgaggaactcggtgaactattaagtgatccggaagttatttcggattctcaacgtttcatgaagttatctaaggaaatgggtaatattcgtgaaacggttgaaaaatataatcactacaaggaagtcacgagtcagatcgaagaaaatgacgaattgcttcatgaaaagctcgacgatgagatgaacgcgatggtcaaagatgatttaaagaaccttaacgcggaaaaggatcaattggaacatgaaatcacgttattgatgttgcctaaagaccctaacgatgacaagaacatcatcatggaaattcacggtgctgctggtggtgacgaagctagtttgtttgctgcggacctgttcaacatgtactcgaagtacgcagaacgtcaaggctggcaagtagaagtggctgatcgtaatgaaactgaagttggtggctttaaagaaatcgttctgatcatttctggtgacaaggtctactctaagctgaagtatgagagtggcgcgcaccgggtacagcgggtgccagtgactgaatcagctgggcgggttcatacctcaactgcaacagtcggcgttatgccggaagcgcaggatgttgacattgatattgatcaaaaagatattcggaccgatgtctttcgttcatctggtgctggtggtcagcatatcaacaagacgtcttcagcggtgcggatgacccacttaccaaccggtatcgtggtctcgatgcaagaccaacgttcgcaacagcaaaaccgggccaaagcgatggaaatcttgcgggcacgggtctacgactactatcagtcacgggaacaaaacgaatatgatgctgaacgtaaatcagccgttgggacgggtgaccgttctgaacgtattcggacttacaattttccacaaaatcgggtgacggatcatcgaattgggttaacgctcaacaaacttgaccgggtgatgaacggcgagttagacgaagttattgatgccctcgttttagctgatcaagctgaaaaaatggagcgcttaactaatgaataagcccactcaacccacttattttgaagcccagcagtgggcttctttttgtctaaaaacggcccagttgccgactgatagtgctcgcttcctgttattgggcttgagtcggctagaccagacacaattactcattcgttaccgcgagccgctacccagtgctgtttggcatgcttatcagcaggggattgaccgggttgttgctggtgagccagtgcagtacgtactcggagacgcaccgttttatggactcacgttacaagttgatccagcagtgcttattcctagagtcgaaacagaagaattggtagactggattttgacggatgtcccagcgacagcgccagttcgactcttagacgttggtaccggctcgggcgccattgcattggcaatcaaacacgaacggccggcatgggagattacggccagcgacatttcaaccgctgcgctgcaagttgccaaagccaatgcggaccgcctacatttagatgttaagctggttcacagtgatctattgaccagcgtatctgcgcagccgtttgatattattgtcagtaatccgccatacatcgctgcgagcgaaaaagacgtcatggacgccagcgtcctcgcccacgagccacaaacggccttatttgctgaccacgatgggttggcactttacgagcagttagcgacgacggttgccgatcatctgacttcgaccggtcgcttatacttggaattcggctaccatcagggaccggccttgcagacgcttttcgcgcagtcgatgcccgacgcgaccgtgacgctgcgacaagacatggcgggtcacaatcggatgctgcgagttgcaatgactctgactcggcaatagttgcgcgttatcctggagaatgctgataaaagcgggccgattaggtagattgctgtttgtaatccgcgtcccattccggccttcgggggtgggtgaacgcagtcgtcgatttgagctcgcgcataacccgcgttatctcaaatgtgagtcttatcctaagcgggctgtttttaacctgggaggtacggcgtaaatttatgagcaattgattaagtccgtgatgtaaataataaagaatattatatgaaagtaacgatgaattaataataaagtagaggtttgaatatattatggaaacgaaagtatatacgccggcggagattccggctgctgcggcgttgttaactgcggggcagttagtggcattcccaacggagacggtctatgggctaggtgccgatgcgacaaatgtggatgctgttaagcaagtgtacttagctaaaggccgcccgagtgataatcctttgatcgtgcatgttgctgatgtggaaacggttgagcggtttgctcaaccgttatcggaagcagccaagaagctgattaaggcgttttggccaggacccctgacgatgatttttaaattgaaaccagatgcgttggcaccggaagttactggcgggctgcagacggcggctttccgtaatcctgataatgaggcaaccctggctttgattcgtgcggccggaacgcctatcgtgggaccatccgctaatacatctggtaagccgagtccgacgacggcgcaacacgtattgcatgatctacgtggtaaaattgctggtattctggatgatggtccgacgaaggttggcgttgaatctacagttttggatctttcaaccgacaaaccagcaattctacggcccggtgccgtaacgcctgaagcaatcgaacgggtcattggcatgccagttcaaaccgaattgcaccatgtcggagctaaagaagttcctaaggcgccagggatgaaatataagcactatgcgccaaacgcacaagtttatatcgttgatcgttcggaagattggccagaagcgctggcgtgggcagcccagcaagatgtgccaatgggcgttatggcaacagatgatattttaactaacaatcaaattccggctaattgcgaacaattttcgcttggagaagatattcaatcggcaagccgggagctgttcgcgggcttgcggcactttgatactgagacggaaattaaagatattctgtgccaagcctttgaaaataaaggacttgggcttgcctacatgaaccgattaaataaatctgccggtcagactcattttagtgtataatgattgcaagtcgggaaaacccgaaagttgtcacttgcgaaatggaggagatttattcatgaattaccaggaacaagatccagaagtatgggctgcgattagtaaggaacaggcacggcaacaacataatattgagttgattgcttctgagaacatcgtttcaaagggcgtccgggcagcgcaggggagtgtgctgaccaataaatactctgaaggctatccgggtcaccgcttttacggtggtaacgaatacattgaccaagtggaaaccttagcaattgaacgggctaagaaattatttggtgcggaatatgctaatgtgcaaccacactctggttcccaagccaatgcggctgcatatatggcactgattcaacctggtgaccgggtgatggggatgtcactagatgctgggggacacttaacacatggatctagtgtgaacttctctggtaaactttacgattttcaaggttatgggctcgatcctgaaaccgaagaattaaactatgatgcaattcttgcacaagcacaagattttcaaccaaagttaatcgttgcgggggcttctgcttatagtcgattgattgatttcaagaagtttcgcgagattgcagatcaagttggggccttattgatggttgatatggctcatattgccggcttagttgcggccgggctacatcctaatccagtgccatatgctgatgtggttacgacaacgacgcacaaaacgttacgggggccccgtggcggtatgattttagcgaaagaaaagtatggcaagaagatcaactcagccgttttccctggcaatcagggtgggccgttggatcacgtaattgcgggtaaagcgattgctttgggcgaagacttacagcctgagtttaaggtttatgcccaacatatcattgataatgccaaggcaatggcgaaggtcttcaatgactctgacttggttcgggttatttctggtggtacggacaatcatttaatgacgattgatgtcactaagtctggtttgaacggtcgccaagtacaagatctgttagatacggtttatattacggtcaacaaagaagcgattccgaatgagacgttaggggctttcaagacctctggtattcggttgggaacacctgcgattacgacccgtggttttgacgaagctgatgcaactaaggtcgctgaattgattttgcaagcgttacaagcaccgacagatcaagcaaatctagatgacgttaaacagcaagcaatggctttaacagcgaagcacccgatcgatgttgattaagtaatttatatcaggtctggttttttctctctaaattagctacaatagaaagaaatcactaaggagtgtgcgtagcaacatgggtaagtttgaggttttggatcatccgctcattcaacataaattgacgatcattcgggaaaagaactgtggtactaaggtcttccgggaaatggttaacgaaatttcaacgttgatggcgtacgaagtatcacgcgatatgccgttgaaggacattgagattgaaacaccgattgccaagtcaacgcaaaaaacgttggcaggtaagaaagtcgccattgtaccaatcttacgggctggcttagggatggttgacggtttcttaaacatgattccggcagctaaagttgggcacgttgggatgtatcgggatgaaaagaccttgaagccggtcgaatatttcgttaaattaccaagtgatatttcacaacggcaattatttgtcgttgatccaatgttagccactggtggttcagccatcatggcgatggatatgttgaaaaagcgcggcgcaagtaatattaagtttatgtgtttagttgcggcgcctgagggtgttaaggcacttcgggacgcacatccagacatcgacgtttacacggcagcacttgatgaccatttaaatgaagatggctacatcgttcctggtttgggcgatgcgggcgaccggttatttggtacgaagtaagttgcattgacaaaaggtagcaccgccaggcaatgtctggggggctacctttttgttttccaaaattattaacaactttagctataatcatccgcattctgtgagttcattagtcatgaatcgtgactaaaacgtgctaatttctaagattaaaagcagccagctatggaccactggaaacgggtgtaagtgggcgtaaacatgctttgctggttcgtcctaagccgacttccagtcgtgacagtgttcgaatggctgacgaagatgtacctaacttttgatgaatttgtcgttgctttttacaaccagtaattttgtcaatcaaccggcagactgaaaatgatattgagatagctcactaatcctgaattggtgtagtaaaatttaatctcttgacaaagtgctaatgcacctaacgctttgtttaaagttccagtgtcaaaatagtcagcgacaaattgtaccaagttaagtggccgttcatcagccatttgagcggcttaccgaccggaggggctgggtgacaatgctcagtagccaaattattcttagtcggaagtgggttgcttccggcttagaataagactcgtatttgagatgacgcgggttatgtgttagctcaaatcgacgtcggcttacgttccagcaattgtcacccagccccggaggtcggaataggacccacaccggctgacgtacaacaatctaattagcacgttttaatcaccgttaatgccaaataataatttgtacaacgcgtatattataggtagttattgacattaattgttgggggacactggataattagggtgttttagatggcgattacgctgtattggtcgaatattcggtaacgttgggtgagaaagtcacattatttcaggaatgttgtcataaatattatgatgttttgaactaatatcgtttttaggggctgttactggttcggttcaaacattgagttgacaattatttcggagacgagtagactaattgcaattaaacagttcctttaaattagctcagagaggctgaaaaggatgaacggacgtgtgctttcaaggaagctgtgcgtaatttcggacagcctagccgctttgagtggtgggctgtcttttcttttgcaatcattcataaaaaggggtgcgttatgacaaagaaagcggcgtttcataatgatgaagtcgtgttagatattcatgaccgaccaaaattaggtagttggttaggcttgtcggtgcaacatctgttctcgatgtttggttccacggtattggtgccaatcctggtgggattaaatccaggtattgcgctgtttagctctggtgttgggacgctaatgtatatcctcatcacgcgcggaaagattccggcgtatatgggctcgagcttttcatttatcgttgtgatgcagtctctgatgaagaccgcaggatatccggccatcgctcaggggactgtcgcggtgggctgtgtgtacctgctagttagtttattagttactttaatcggttctgactggatcgataaggcgcttcccccgatcgtcgtggggccgattgtgatggtaattgggttgtcactcgcagggacggcagctaaggacgcaacgatgaacgggagtagttatgatattaaatatttcggcgtcgcgatggcgacgatgttactgaccgtcatttttaacatgtacttgcgtggatttatgagtttagtaccgatattgttgggaatcgtctgtgggtatatcattgccgtgttagttggaatcgttgacttttctggtgtggaaaaagcgcagtggtttgcgatgcccgcctttcaattgccttttattagttatcatcctggcatttattggggcgcgattctgagtatggcaccaatcgcctttgtgacgatgtcagaacatatgggccatattatggtactcaataagttgactaagcggaatttcttcaagaatccaggtttgaaccatacattggctggcgacgggacagcctcgattatcgccggctttgtcggtggaccacccgtgacctcctatggtgaaaatattggggtgctggcaattacgcgggtccacagtatttatgtgctcggtggggccgccttttttgccatcgtctttagttttgtgggtaagttatccgcgttgatcgagagtattccatcacccgtcatcggtggggtcagctttctactgtttggggtaattgcttcaagtgggatgcgaattctgattgataataaagttgattttaatcagaagcgaaatttaatgattgcatcagcgattttggtcattggaattggcaatgcctatttacaactgggaagctttcagttcagtggtctagcagttgcaacggtgctcggaattgtgatgaacttggtgctgccaaagacggcggtaaatgagaagtaggccgtcattgcgcgtgccaagaatgaaaataaagtcaaaataatgaaaatccaacgatttgaaagcttaatgaaagcttgatattgttggatttttattgattgacgaaatgttgaaattattttgaattttttcgacggtggtggtattattacctttgtattttgattaggggtgtctctaatctaccatttcaggttacgataaaattgacgttgactagctcaaaggttaaggttatcgtagcaccgaaattaaaggaaagaggtgatattcagtgggtgatccagttcctacagtcaaattccttggactgacgtttaatatcgcgaatgacatctcagtaattgtgacttgtctgattgttttcttgtttgtttttttactttcgcgacatttaacaatgaagcccaagggtggacaaaatgtgctggagtggctcatcgagttcacgaatggcattgtcaaagggtcgatcaagggtaacgaagcgtctaacttcggtttgtacgcatttacattgtttctctttatcttcatcgctaaccaacttggattgttcattcacgttcaggtcgggcagtatacgtatctgaagagtccaaccgccgatccgattgtgactttgacgttatcgtttatgaccgttgcacttgcacatgctgcgggtgttcgtaagaaaggtatgggtggttatttgaaagaatacacacaaccttttgctgttttctcggttattaacgtctttgaacaatttaccgatttcctaactttaggtcttcggctgttcgggaacatctttgctggtgaaatgttactaacgaaggttgctgatttggcaaagagcaacggttggttgagctatgtttactcatttccaattgaactcttatggcaaggtttctcagtgtttatcgggagcattcaagcgttcgtgttcgtaaccttgacttcagtttatatttctcagaaggttaacgacgaggaataatttctagttttttaattttaaggaggatacacagattatgggagcaattgctgcaggtattgctatgtttggtgccgctttaggtgctggtattggtaacggtttggttatttctaagatgcttgaagggatggcccgtcaaccagaattatctggtcaattacggactaacatgttcatcggtgttgggttgatcgaatcaatgcctatcatttccttcgttgttgctttgatggttatgaacaagtaatcattggtcaacgagttcattttaatgaaaatgaaagaaggaggtgtcattagatgctctcgcatttaattatcggtgcatccggtctctaccttggtgatatgttgtttatcgggattagctttattgttttgatggcattgatctctgttgttgcttggaagcccatcacaaaaatgatggctgatcgagctgacaagattgcgaacgacattgattcagcacaaaagtctcggcaagaagcgagtgacttagctgatcaacggcgtgatgcgctatcacactctcgcgctgaagcgagtgaaattgtcgctgacgcgaaaaagagtggcgaaaagcaacggtcaagtatcgttgccgatgcgcaaaacgaagcaacgcagtataaacaaaatgcgcgtaaggatattgaacaggagcgtcaagatgccttgaagaacgtccaatcagacgtcgctgacatttcggttgcgattgctacgaagattattaagaagcaattggatccggaaggccaacaggcattaattaattcgtatattgaagggttgggaaagcatgagtcttgataatcttacaattgcaagtcgttattcaaaggcactctttgaacttgcagttgaaaaagatcagaccgaagcattcctggccgagttaaagcaattacggcaagtctttgtcgacaacccgcaattggcagaggtcctctcaggatcattgcttccggttgatcaaaaacagacaacgttgtcaactttgactgaccacgcttcagaatacattaaaaactttattcaaatgttgtatgattacggccgcatgtcgaacttagttggcattgttgacgcgtttgaagcacgtttcgatgagagtcgcaaaatagtgcatgccgaagtaacgtctgcggtcaagttgtcagatgagcaagctgatgcaatcgcaaaggcattcgccaaacgtgttggtgccaatcaggttgttttgtcacgtaaagtcgatgaagcaatcattggcggtgtaattgtgaagtcaaataatcaaacgtttgatggtagcgttgcgttacaactaacgaatttaagacgagcactcatcaacaattagtttacgaagaggtgaaacttttatgagcattaaatctgaagaaatcagtgctctaatcaaacaacaattagaaagttatcaaactgagctctcagttgctgaaaccggtactgtcacctacgttggtgatgggatcgcccgtgctcacggactcgacaacgccttacaaggtgaattactcgaattcagtaacggagtttacgggatggtacaaaacctcgaaagcaacgatgttggtatcgttgttttaggggattttgatggtattcgtgaaggcgatactgttaagcggactggccgcatcatggaagttccagtcggtgacgccatgattggccgggtcgttaacccattaggtcaaccagttgacggtttaggtgagattaagaccacgaatacgcggccaatcgaacataaagctcctggtattatgcaacggcaatcagttagcgaaccacttcaaactgggatcaaggccattgatgccttagttccaattggtcggggccaacgtgaattgattatcggtgaccgtaagactgggaagacgtccgttgccattgatgccattttgaaccaaaaggaccaagacatgatttgtgtctacgttgcaatcggtcaaaaggactcaactgtacgggcccaagttgaaacgttgaagaagttaggtgcgatggactacacaatcgttgtaactgccggacctgctgaaccagcgccattactgtacttagctccttatgctggggcagcgatgggtgaagaatttatgatgaacggcaagcacgttttgatcgtctatgatgacctttcaaagcaagcaacggcttaccgtgaactttccttgatcctccgtcgtcctccaggtcgtgaagcttatcctggggatgtcttctacttgcactcacggttactcgaacgggctgccaagttgagcgatgaattgggtggcggttcaatgacggccttaccaattatcgaaacgcaagctggggatatttcggcttatattccaactaacgttatttcaatcaccgatgggcaaatcttcttggatagtgattcattctattcaggtgtgcggccagcgattgatgccggggcctctgtttcccgggttggtggggatgcgcaaattaaagcgatgaagtccgttgccgggaccttgcgtcttgacttggcttcttatcgtgaattggaatccttctcacaattcggttctgacttggatgctgcaacccaagcgaaattaaatcgtgggcaacggatcgttgaagtcttaaaacaacctgttcattcaccattgaaggtcgaagaacaagtaatgattttatatgctttgaccaacggttatttggataaagtggcagttgatgatattgcccgttaccaaagtgaattgtttgaatttattcatgctagtcatcaggacctctttgatacgattttggcaaccaagaagttaccagaagctgataagatgaatggggccttagatgcgtttgcagaacaattccagccaaccgctgccgctgcgaagtagttatggctgaaaaggatggtgagtagtgcatggcagaatcattaatggatgtcaagcgccgaattgactcaacaaagaagactcatcaaattacgtcggcaatgcaaatggtctcaacttcaaaattgaaccagattcaaaagcataccagcacgtatcaggtgtacgcttctaaagttgaaagcatcgtttcacatcttgccaaagctcatctgatgtcagcaagtgccggtgttgctaacagtaattcgaatacgatttcagttagtgaattgctcgcgcaacgccccgttaaaaagactggtttattggtgatcacctcggaccgtggcctcgttggtagttacaacagtaacgtgttgaaacagactaacgatttcatgcggacgcacaagattgatgccgataacgcagtcgttttggcggttggtggcactggtgcggatttctataaaaagaacgggttaaacgtggcttatgagtaccgcggcgtctctgatgtcccaacttttaaagaagttcgtgaaatcgttaagacagtcacatcaatgtaccacaacgaagtctttgatgaactctacgtcttctacaaccactttattaatcggctctcttctggttttcgggccgttaagatgttgccgatctccgaagagacctttgaacaaagtgagtcagataatcgtaaagccaaggatagccgggtagatgtcggtcccgagtatgaaatggaaccgtcagaagaagccattttgtcggccgtgttgccacaatatgctgaaagcttggtttatggtgcaatcttggatgccaagactgctgaacatgcttcgtcgtcaaccgcgatgaaggctgcatcagataacgctggcgatttaatcgataaattaaatctgaaatataaccgcgcacgtcaagctgctattaccactgaaatcactgaaatcactggtggtttggttgcgcaagaataacgaagtgggaggaattaacgactaatgagtacaggtaaagttgtacaagttattggacccgttgttgacgttgaattctctctaaacgataagttacccgatattaataacgccttgatcattcagaaggacaacgatgacactttaacggtggaagtatcgttggaattaggtgatggggttgttcggaccgtcgcgatggatggtacggatggcttgcgccggggaatgacagttgaagacactggttcttcaattactgttcccgttggtaaagagacgttaggccgggtcttcaacgttttaggggaaaccattgatggtggtccagaattcggtccagacgcagaacgtaacccgattcatcgggatgcgcctaaatatgatgaattaacgaccagtactgaagtattggaaactggaattaaagttattgacctcttagcaccttatgttcgtggtggtaagattgggttgttcggtggtgccggtgttggtaaaactgttttaatccaggaattaattcataacattgcccaagaacataacgggatttccgtgtttaccggtgttggtgaacggacgcgtgaagggaatgacctttacttcgaaatgaaggcttccggtgttttgaagaataccgccatggtttatggtcaaatgaacgaaccacctggtgcccggatgcgggtggccttgaccggtttgacgattgcggaatacttccgtgatgttcaaggtcaagacgtgttgttattcatcgacaatatcttccggttcacgcaagctggttctgaagtttccgccttacttggtcggattccttcagccgttggttaccaaccaaccttagccactgaaatgggtcaattacaagaacggatcacttctaccaagaaggggtcagttacttcgattcaagccgtttatgtgcctgccgatgattataccgacccggcacctgcaacgactttcgcccatttggatgcgacgaccaacttggaacgttctttgacggaacaagggatctacccagccgttgacccattagcttcttcctcaatcgctctggacccatcaattgtgggcgaagaacattatcaagttgcaacggaagttcaacgggtcttgcaacgttatcgtgaattgcaagatattatctcgattttagggatggatgaattatctgacgaagaaaagacaactgttgcgcgtgcacggcggattcaattcttcttgtcacaaaacttcttcgttgccgaaaactttacgggccaacctggttcgtatgtgccaatcaacgataccatcaagggcttcaaagaaattcttgaaggtaaatatgatgacctaccagaagacgcattccgtcaagttggtaagatcgacgacgtggtcgaaaaagcgaaatcgatggtaactgattaggaggggtttacatggctgacaatgcaaaatcattaaccgttagcatcgtaactccagacggtcaggtctatgagaataagacgccaatgttgatcgtgcgaacgattgacggcgaactcggaattttgccgaaccatattcctgtgattgcatcgcttgcaatcgatgaggttcggatcaagcaacttgaaagtgatcaggaagatgacgaaattgccgttaatggtggttttgttgagttcagtaataatacggcaacgattgttgccgatagtgctgaacgtcagaatgacattgacgttgctcgagctgaaaatgcacggaaacgcgctgaaacacggattcaaaatgcccaacaaaagcacgatgatgctgagttggcgcgggctcaagtcgctttgcggcgtgctatgaaccgtttgaatgttgctcggcattaacaacttaaaattctgaaaagcatctgcaattatttgcgggtgctttttttgtgcggttcagttaagccgcgatgcacaagttagtcaaacttaccgcggtgagtcgtacccgttactgtccagttttaagcttgcacggttcaaagcagattggaaccgtgggttgatcaagggccaagcactggcttactaatggcgatatcgcgttgttaactagaagaatcggtctgattcggatatttttcgccaatattgcatcagtatctggcagagcagtaattaagacgtgaatcgcgtcttaaaagggtgatcatcacgttccgacaattggcagcaattccaaaggtcggcataggaaacatgaacaactaagtttacagcgaacttaaacgtttcagcggccaattttgtcgcgacgttgaaatgttttgtccagtcggcgcggatgttcgtgaactaaattttactaatcgattgagcgtattaggggcattgcgataagtggaatggtagaatgcaacttatagtgagattacaataaagaaaacgattacaaacgaacgatactgctaatcaatatgggtatggcttgtcaaataattgcacgacggacttctaattagttaactaatcataagtatttaatatttgtgttgaaattgtaacgaaaatgtaaaatgtaatatttatccactagtgttctatggtatgatgattaggaaccgatttgaacctgcatgctgctattggcaagttgccatggtgtgtccaggttgttttgatggttgagctggtgtttggattgcacaccgcgcgttgccgatttgcttagtacagcggtgaacagtggaatttgggcaggtgcgaggcatctgatccaatcgggttcttttagtaagtgtgctttttacgcaatccgaaatctcacgtaacttgtttgttgattatcgtttagtgatggagggtttatccatggaggaaattgtagttcatggcggtcaacgtttgacaggaaatgtccatattgagggcgctaaaaatgccgtgttaccaatcttagccgcaagcttgttggctagttctggtcagacacatttatcaaatgtaccagtgttatcagacgtttttacaatgaacaacgtcttgaaatttttgaatactaaaattgattttgatgaaattaataaaacaattgatattgacgctagtcgtcaattatcatccgaagcaccatttcaatacgtatccaaaatgcgtgcttcaatcgtggtcatgggaccactattagcacgattaggccatgcgaaagtcgcgatgccaggtggctgtgcgattggttcacgaccaatcgatttacacttaaagggactgaacgcgcttggtgctgaaatcgaacgccacgatggctatgttgaagcaaccgcgaaccagttacacggagcggccatttacttagattttccaagtgttggggcaacgcagaacataatgatggcggcaacacttgcagatggcatcacgacgatggaaaacgtcgctcgtgaacctgaaattgtggacctagcgaactatttgaatcagatgggcgctaaggttaccggggccggtactgaaacgatccgcattgaaggggttaaagcgatgcatggctgtgaccatagtatcgttcaggatcggattgaagctgggacattcatggtcgctgctgcggtgactcagggaaacgtcttggttgaggatgctattgccgaacataataagccattgatctcgaagatgcgtgagatgggcgtcacagtaacggaagaaccggctggtattcgggttattggtccagaaatcttgaagccaacctccgttaagacgatgccccatccgggtttcccaacggatatgcaaccacaaatgacaattttgcagttgtgtgcgcagggcactagtttattaactgaaacggtttttgagaatcgcttcatgcatcttgatgagttacggcgaatgaacgccgacttcaaagttgaagggcgctccgtcattatgtatggtcccactgactttaacggggcccaggtcactgcgacggatcttcgggcagctgcagcgttagtaatcgctggactggtcagtcggggttacactgaagtgactaatttgaagtatcttgatcggggctactttaacttccatggtaagttggctaaattaggtgctgagattaaacgagttgatgttcccgatggcaccgtttatgcgttgaatcctgattttgcgaacgaagctgcggaataaatcgaaataaatgcttacaaaaccttcaaagtgcgataaactcgtttttgaaggcttttttgtggcgaagcggggtaaacccggcgccaacattcaggaggacagcttatgtttattaatattatcgacaaacacatttcattgaaaccaactgaagtggctgacgcggagccgcttttcgacttagttgatcataatcgcgaccatttgaagttatggatgccgtgggttgatgcgacggcgaccgtgcaagacgagcgtcattttatcgaatcaatgttgaccaagcaggctcatggacaggtgtttatcaccaccatcattgtggatggcgaagtcgctgggatgctagacttgcataatattagtgccattaatcacaacggtgagattggctactggctgggccagaaatatactggtcgtggcgtcatgactaaagcgctcgaacgattagaagaaattgcttttacggagcttgatctgcacaaggtcatcttaggtgcagacgttgccaaccaggcaagtcgggctgttgctgagcgacgccaatatcatttggatgcgaccctgccagaaaatatcttgttaaatggtcaatatcgtgatgaagcaatttattcgctgacggtcgatgagtggtcgaaacgacaggatgattaggcacagccaattgattggtagtgacaaatgaacgagtggctaggacagccgtcagttctcatcaactgtagagtatggtataatgattagtcgtataattgtatgtttgagaggagcaaaaacatggctttagatattggtattgacttaggtactgccaatgttttaatttacgtatcgggtaagggcatcgtccttaacgaaccatccgtggtcgctatcgatacgaacacgaatcaagtgttggcagtcgggtccgaagcctaccaaatggttggaaagacgcctagtaacattcgggcaattcgaccattaaaagacggagtaatttcggattttgatgtcaccgaagaaatgctgtcctattttattaaaaaattaaatgtccgtggcattatgtcgcggccaagtatcatgatctgtaccccaacgaacactactgaaattgaacgcaaggcaatcttgcaagctgctgaaaaatctggcggtaacaaggtttacttggaagttgaaccaaaagtggcggctattggcgcagggatggatattttccaaccacgtgggaacatggtcattgacattggtggtgggactagtgatatcgctgtcctatcattaggtgacattgtggcaagtagttcgttacgaatggccggcgaccggatgaatcaggacatcgtgaactacgtcaaagatcaacatcacttgttgatcggtgaacgcagtgcagaacaagttaagattcaaatcgcacaagttttcaagcaggacggcgatgatgataaggtcacccaagttcgtggtcgagatactgtgacggggatgccgcgctcaattgacattgactccaatcaagttgaagaagctattcacgaaacgctgatgcagatcgttagcacggcccatcacgtgatggaaactttaccaccagaaattgcggccgatattattgaccgtggaattacgttgactggtggtggcgcactgttgagtggcctcgatcaattgatcagtgaaaacttaaaggtgcccgtaatggttgccgaacacccattgaacaacgttgctcagggggctggaattttacttgaacatatgcagaaaactgctaagaacaagaaataaattacgatgcgacggttattaatgaaaggcatccgcttttatcagcgggccttttctgcgtttagtccggctcattgtcgctattatccaacctgttctaattacacgttagaagcgatcgatcggtttggcgcagttaaaggcgttctaatgggagttgcacgtatcttacgttgtcagcccttagttaagggcggctttgatccggtaccagcccatttttcattgcgtcgtaatccgcaatacaaggaggaagaccaccgtggcaagaaaagataaggcgatttcggtcactttaaacgaaactaaggtcaacggtcaaccagttaccgaagttttgatcggtaaacaagtgattggacaagtgactcaagtcggtgaacgatttgaagctgaaatggttagtgacaaccaaccatttgcgcataccaaatcttttgatgagagtctgcaagagatcttgtcggcttaccatctacacaaaggctaatttttagtaaaccttcaacctggttccgagaattcggcaccaggttgttgtataataaaaactatcttaaagtacaaaatgatattgtgaatagggttagtctgacgcgtgcggtgggctaatcccaacaggttaggagcgttatttgtggcagaagaatctagactccgcagtcaagacgaggattcaagaattgactggggtatcatattttcagtgatgatgctaggattgatcgggctggcgtcgatttatgtcgccgcagtgcacgactctagttcagtaaacgtcacgaagcaggtgatttctcaagtcatgtggttcgtgattgggaccgcgattgccgtaattgtgatgcaatttgattcggaacagttatggcgagtggcaccgattgcctattggtttgggatcttcctgcttgcggccgttttggtcttgtacagtagatcactgtttgcgagcactggggctaaaagttggttcgcagttggttccttgacgttgcaaccgtctgaagtcatgaagcccgccttcatcttgatgcttggacgagtcgtgacaatgcataacacggagcacccaacacatacgatggcgagcgattggcaactcattgggaagttaattgcgtacatggtgccagttgctatccttttgaagttacaaaatgactttgggacgatgctggtgttcttcgcgattcttgggggcgttatcttagtttctgggatttcgtggcgattattggcaccgacgtttgccattgtggcggcgattgcggggactgcgttatatctcgtgatctcgcagagtggtcgccatattttggaagctatcggttttaagcaataccaatttgcgcggatcgatacgtggttgaatccgtcgacggacacgtctaacaatgcttatcaagtttggcagagtatgaaagcgattggttcaggtcagattactgggcggggatttaacgtttcccacgtgactgttcctgtgcgtgaatctgatatgattttctcggtaattggtgaaaactttggctttatcggttgtgccgtggtcattttattgtatttcttattgatttaccagatgatccgagtgacgtttgatacgaagaacgaattctacgcttacatttcaaccggggtcattatgatgattctcttccacgtgttcgaaaatattgggatgagtatcggactgttaccaatgactgggattcccttgccgtttattagtcaagggggttcggcgttgattgccaatatggctgggataggtttaatgatgtcgatgcgatatcattacaagtcctacatgttcagtcgtaacgaccggtttgaatagtaaaattattgtaaaggtatggtgtttagtatgagtgaagatgcagcttatttttggacaaaagacgttgatggacatacgcggttaggtttaactaaggccgcccatgaggctcttggtgaagtgaaatatgctgagttaccagctatcggtgacaaggtcagtcagaacagcgcttttctgagcgttgaagcgaccaaagccgtttctgaattcaactgtccaatcaatgggaccgtggttgcggtcaacccggcgttgagtgagaacttcgatgcgttaaatagcgttgaagacggcgttgcttggttaatcgacgtggactaattaccaggccttgacaattagaaacaggctcggtatactcgttacattaacaattgattaaaaaagttatcattttgaaaagatgagtacgcggttatgattacttagagagtccctgattggtgaaaggggattaatcgtgaagctgaagatggtcttgaagtaatgaagtttagtgagcagtcgcaagctaagcttgggtcgcacccattatcatgcggagttcaaagtaactcttgagacaactggcgtgagctagttgtgaagatgggtggtaccacgaggctaagcttctcgtcctattgatgattattgtcgtaattgtctgggatgaggagctttttttgatgcgtaaggaggaattgacttgattgaatttaaagatgtgacgaaaacctttgatgctaagcaaggggcggttcacgccgttcaagatgttaatttaaaaatcgaagatggtcacatttatggcattgttggctattcgggtgctggtaaaagtactctggtacggatgctgaatggcttagagacacccactagtgggtcagttgtgattgatgatgtcaatattacaacgttgagcggggccaagttacgcgcccaacgtcaaaagatcggcatgatttttcaacattttaatctattatggtcgcggaccgttttggagaatattatgtttccacttgaaattgctggcctgtccaaggtggatgcccgtaagaaagccgaacacttagcagacttggttgggttggccggtcgggaaacggcttatccgtcagaattatcaggtggtcagaagcaacgggtcgggattgcccgggcacttgcgaatgatcctcagattttactttctgatgaagccactagtgccctagacccgcagacaactgatgaagtgttggatctgttgttatcgatcaaccagaagctccatttgacgatcgtattgattacgcatgagatgcacgtgattcgtaagattgctgatcatgtcgcggtgatggaagctggtaaaatcgtcgaacaaggaccagtacttgaagtcttcaagcgaccacagcaggctgtgactaagcggtttgttaatgaagaggtcacgccgtcgctgaatgacacaacggtggtcgtggaccagctgctggcgaaatatccaaagggaaccatcgtacaactgacgttccatggcgatcaagcccagctaccgattgtttcagagatgttgaagaagtatccgttagatttaaatattattgagggtgggattcaccaaacccaagaaggggcgattggttcgctgtacttacaactaacgggtgatcaggaacagattaagggcgctctagcgtacctacaaacgatgcgggtggaaacggaggtcttgaaccgtgaatgatcaaggattagattcatattttaaatttgcaaatgtcgattggggtagcatgatgtcggccacgtgggaaacaatttggttgacgattgtgtcgatggtcgtagttgccattctcggaatcgccttaggtctgttactttatgagacggcggggagtcagaatccgctggctaaggccttgaattggatcgttgcgttgtttgtcaacgttttccggtcgattcctttcattattttgatcgtgctattattgccggtaacgtctaagttagttggaacgattatcggaccgcgcgcggccttaccatcactgattatttctgctgcgccattctatgcgcggatggttgaattggccttccatgaattggatcatggagtgattgaggccgctgaatcaatgggggcgacccggtggcagattattcgaaaagtcctattgccagaaagcatgccggcattagtttctggaatcacggtcacgacgatttcattaattggctacaccgcgatggcaggagccattggtgctggtggtctgggtgatttggcctaccaagacgggtttcagtccaataacaacgccatcacattagtggcgacggtaatcattgtgattatcgtgtttatcttccaatttatcggggatattgcagttcggcatattgataagcgggttaattaaagttcgtataggaggaaacggaattatgaaaaaaaagggaattctaggattattagcagttgcggcaacggcaattttgttagtcggttgtgggaagtcatcgtcaacaaagacaacaaccattactgtaggggcttcttcagtgccacacgcacaaatcttgaagcacgtgcagccagaattgaaaaaggaaggcgttaacttgaagatcaaagtctttcaagattacgtcttacctaataaggcattggcttcgaaagaattagatgccaactacttccaacacattccattcttggataactggaataaggaaaataatgggagcctcgtatcagcggggaaagttcacttggaaccaatcggtgtttattccaagaaagttaagagtctaaaagacttgaaagacggcgcaaccgttctggtcagcagcaacgtggctgactatggtcgggtcctgacgttatttaaggatgcgggtttaattactttgaaaaaagggacagatttaacttcagcaacttttaatgacattaagaccaacaaacgtcatttgaagtttaaacattcatacgaagctaagttaatgccaacattctacaaaaataacgagggtgacgcggtcgttattaacgcgaactacgcggttcaagctgggttgaatcctaagaaggatgcgattgcacttgaaaaatcagattcaccatatgccaacattgtggctgttcgtaagggtgataagaacaagccagctattaagaaactaatgaaagctttacgttctaagagcacccagaaatggattgaaaagaagtacaagggtgccatcctgccagtttcggccgactaaacggaccatcttaaatcagaatattgattgattgagctagcttcagggattccctgaggctaacttttttcacggagtttgactacggtaactttccgaagcgggttaatgaaaatgcacgtttgatattatctaagtagtactattgattaaattcttatgagacagcgtcctgcttgactttatagcggttgcaaggtacgctaaccaagttaaataaactacagattggggtttgcagcatgcgtaaatatggtgtgatcgggttaggccaagtcggtgcgacagtggcttatacgttggttcaacaaggaaccgttgatgaattagttttaatcgataagaatgaggccttggccaaggcgcaaaaactcgatttagacgacgcgtcacctcgtctaagctcaaccactaagattattttaaacgattattcagctttggccgatgccgaagtgttgatcgtggcttctggcaatattggtgccattgatatgaatagttccaagggtcgctttggtgagtatgatttaaaccaagcgattgtacgggagatcgcgcccaagattgtggcatctggcttcaagggtattttgatcgatattatgaatccgtgtgacgtcatgacggattatttacaacgaatgacaggttttccacggcaacgggtttttggtacggggaccttcttagatacggcgcggatgcaaaagtatgtcggacaagcagctggtacgaatggtaaaaatgttgcggggtacgtatatggcgaacacggcaactcacaatttgtagcttggtcaacggttagcgtgaatgggcagcctatcaaaaatttcccaggtctgaaccttgatcaacttgaagaagatgcaaggcaaggggcatttgcagtcatggcgggtaaacattatacaaactttgcgattgctacttgtggtgtccgattggcagaagctgtcagcgcggatgcacaactggcttgcccagtttcagcttttgatccgcaatatgggacatacgttggcatgcctgctgtgattggtaaaaacgggattgaatcattaattcaactagatctgaccactgatgaacgagcgtcgttagcagcgtcagcgaagtttatcaagtcgcaagtggacgttttaccgcaagcataagctttttctaagcatggattgaaacatcttgtcattaaacgtggcctaatcagggtgtgcggtgtggacttgggtattggctcaggttggcttcgtgacgtctataattaggtcacgttttatgattgaatggttcttttgggcagacaggcgctgacatgctaaaatagaaggtaaattcgagattacgaggtcattatgcaagcagagaaattgatgcaggttaaggatgcagtgttaaagttaagacaacaacttcgagcgggacaaatctatcagtcactgcccagtcgaatggcaacgctgattaagcagttaccgagtaccgtgacaaccacggtaacgattccgagcgacgaagaggtgcttccactgattgcaacacttcatgagcagttgaagaaaggcacgttgaccgcgatgagcgacgatcaaatcaaattattgatggcacacgttggttcgctgaatccgctggttcgtgatcaaggcgtctactatttgttaaacgaggcattacagcagcaggtactcacaccggaacagttgggcgatatttttgatcagttgattcaagatcagatgttatttgcacacatcgatgagccgcaaaatgatgccatttatcagcggtcatttgcgatactattactgtcagtgctcttgtatgcggaccatgcgggtctcaagtttatgacacccgcgcggctggatctagttgttgagcaaatgacagtctacattttactcgaaaaggatactcgggggtttgtgggcaccaccggttgggcgcatgcgtacacgcatattggtaatatcttagatgaactggcagatgagtctcaactcgcacgtgcggataaattattactgttggccgcattgattgctcgttatcaaaagttaacaacgccgttgatttttggcgagccagaacgactatcgacttatttgaccttgattacaaacaaacatgagctttattgtgattatttgttaactgcgatgaaggactggcatcagcagttgatgatgcatactcgtccggctagtgaagctgaatggacgcagattttcaatcgtaatcgattattggaagcacttgcattacacgatgatctgccaacggccgtcgtagattatttggatgatgaattagaatttttaggttagttttggaaggaagtcttttgaatgcaggcaaaagcagttggattaacgcaagggttgccagtgagcgatccgaatagtttacaagatgtcaccattaatgtaaatcaacctcgtggccgtgatatcttagtagccgtcttagcaaccgcagtcaatccaatcgatacgaagcagtggcaaggtcaatcgccagtgacaacgccgcgaatactaggttttgatgccgttgctaaagtgttggcggtcggtgaagcagtgacaacgattatgacagatgatgtcgtttattatgctggcgccgtcgatcggccggggagtgatgctcagtatcaattggttgatgaacggttagttgcgtgtgccccgaaaacgtggtcgccggcgcagtcagctggtctgccgctaacgacactgacagcttgggaagcattgtttgaaaaattaccattcactgcagcggctgacgcgaatcttggtcagagcgtccttatcatcaatggtgctggtggggttggctcgatggccatccagttggcaaagtgggcgggtcttcaagttattacgacgactggtaagccagaaaccactgaatgggttaagcggttaggtgctgatatcgtcttagattaccatcaggatctgggatcgcaattagctgcggccggtttgcaggctgtcgatcatgcgatactattacactctacggatcaatacttgccattagtgacaccgctagtccggccacttggcacgatcgtcgccgtagtgacaaatcagcaccccttgccaatggcgttactaaagccgaaaagtttgaattttgcttgggagtttatgtttacgaaggctaactatcagttgccatcgatggcgacgcaggggagtattctggcacaggtagcgcaactggccgatgccggggtgattgtaccgacgaccaagcggactttagctggaattaatgcagcaaatttgcgaactgcgcacacaatcgtagagacggggcaaatgttgggtaagattgtcttgactgcgccatttgacgcgtaaaaaacaacgttttattgtaaaaatgttttcaattgtgctcagatattgtagaattaactaagccgtagtatgaaataaaccttgataggatgaacaaaattatggagacacaaaaaaagatccatgttggtatgttgtttggtggtaactcttcagaacatgatgtttcgaagcgttcagcgcacaacatttatgatgccatggacaagaataagtacgagattgacttgtttttaatcacgaagaacgggattgtcttgagtgatgctgcaactcggcgcgtatttgatggtgaaccagaagatcaagtcgtcgccgaagaaatgccaaagttggacatgagtgatccattagctcccatcaagaacctgacactggccaaagatattgatatcttctatccagtggttcatggtaacttaggggaagatggtactttacaagggctgttcaagttattgaaaaagccgtatgttggtagtggtgtcttagcgtcggcagctagttttgataaggatattacgaagcagattttaacgcatcatcatattcaaaacaccaagtacgtggtggttacaccggaaaaccgggaccaaatgacgtacgcttatttacaagcccacgtgggtgatcatttattcattaagccagccaatcaaggatcgtcgattgggattcataaagctgagaatgaacaagaatacttggatggtttggccgatgcgttcaaatatgactacaagattttagttgaagaatcgattgacaatccgcgtgaagtggaatgctcgatcttaggcaatgaaaatcctaaggcatctaagcttggtgccattgatgtgccgaagacggacacgttctacgactataataataagttcgtggatgcgagtggtgtgacgttcgaattaccagtcgaattaccagctgatttgacgaaacggattcaacagatgtcgctagacgcgtttaaagcgcttggtctaaaaggaatggcacgcgtcgatttcttagtgtctgaagatggtgaaccatacttgggtgaaatcaatacgttacctggttttactaacattagtttatatccaaagctatgggaagtttcgggcattagttatacggcgttgatcgatcaattgatccaacttggttttgatgaattcaaacgtcaatctgatattcactatgatttcgttgcgttagacgcggaataagatagtaatgagttttgtggtggttgggatgaagcgattcatcacggccgcctttttttgtgaggaggggtcaggttgttaagtcgcggatggcacttagtgatgcagggagcgcgccaactggctggaccgctagcctgctggtggttggccggcatattgctggcggtactcgctaaggtgctcgggattctggtcggtggggtagtcagcttgctaggcttgttgcttttgagtgcctggttaccagccatggtcgctcgtagtaatcatgagtcgtggcaggccggtcaatttttgtatcgctgggtgctgttaatgtttacggcggtgtggtggttaccactcggttggttaggctatttagcaactttacaagcgagcatacaattgccagcgactgttcaaaatataatctttaatacgcgttatgactggcttcctgtggcgggaccactttggctgttgggctggctgattagctggaagtggttaccagcacttcaacgccaattgaccgctccgaccagctggcgtaattattggcgaacgggttggcggatttcctggtggacagtctttaaaaaaagtcgaaatgtgtggctgttcctgattagctggctcgttatggcaatcattagtggtggcatagtgtgggctagtggcgctgttagccagctggtcagtcaatttattgcagttttcatgatgactgggttgcaactgctggcttggttaatgtttatgggatggtggtcgtgcctttggccagaaacagcaatcgccggtcactctaactggcaaactgggctacttacgttgaccggtttgctagtcttgggtggttgcgcaggctggtggctaggaacgccaccaacggcgccgctagcaattattgcacatcggggtgttaatggtcgtgacggtgtccaaaataccacagcggcgcttaaaaggactgtaaagcaagttcagcctgatatggtcgaaatggatatccagccgacagcggatcgccactgggtcgtcatgcatgatccaacgctgaaagctttagcgggtcaacccggtcccgttcatgagtaccccgttgataagttgagtggattaccactacgggagcatggtcaaaaaggctacttgagtacgtttaagcagtactttgcggtggcacacaaattacagcaacctttattagtcgaaatcaagtcagttgggacggctgatcaactaatggggatttttgccgacaactatgcacaacgactgatacaacaaaaaggggcggtacactctttggactatcgtgtgattgaacgattacatcaacgggcggcgcaactaccggttggcttcataacgccgttttatctgacggatttttctaattccgtcgcgggattttattctttacaagcactgaccgcgacccgtgagcagatcagtgcggcccaccgccaacatcggatcgtctacttctggactgttgatcggccgcttgcaatgcagcgactgacggccatgggggctgacgggctgatcacaaatcgaccgggccaactacgaagattacagggtcaatctaagcattattatttttatcaattgataaattggttagttagttggttataaactactgaaagaagtatgagaactaatcttaattattaagccacgtcaaccgattaattgagggtgtcatgacaattgatgtttgctgttaataaggttaattcgctcccctttaaatcgctttcagtagttctcacttttaatgaacaagtccttgattagggtggttaacgaactgtaagcctggataattaataaatgaccttcggccgatatcatggtataaacttaatattaaataagaattacgcgtatttcttgctaaaattccgttatgtgaatataattatatgcgtaattggtattgtccaattggttagtgctcaattattcgaacggattaacgaggattgattaggtgtcacgatacccttgttcatttagtgggggcagcaaggggagttacaaaatgagtttggtttaaggcaatcaatgaagaggggttaagcatgagaatattaggagaaaaagtgcggcagttcagaaagcggaagggcatgtcgcagaaggaactggctgatgggatttgtactcaggcaacgattagtctaatcgagaaaaaaagtaaaattccaagtatgaagattatgatgaaaatttgtaatcgattaggaattcgtttatcggaagtcattattgaaaatgacgaccagttatatcggaccttcaaaaaaattgatactttgattcgacatacacaactggaagaggctcaggatgtgttccagcatatccgtccgaagcagttacgtagtaatacggataagaaacagtattattactatgagggctatcttcaattagtgctcaatgacaatgctgacgaagccatctttaactttgggatgttgcttaatcagttcgtcaagtctagtcacgatatgtttgccatcctggccacacttggaaccggcttagcttatgaacgtaagcaggcctatgacaaggctgaaatttttgtcaaacaggcagttgctaccttacacacaatggatgcgcaagcaatgccgatgggtgacgacgattacttacaaaatgaaattttgatttacgcctcagccgcacaattgtatgctaagatcaattttccagaggaagctttggagttgatcgacttggcactcaagaaggctcaggagagtcagtcactttatttattagaccgtttgtatgcacaaaaggcggccaatgaagttgttttaaataatgtccagtcagcgcatgatcactattacgtggcgtatgcgttaagtctggtgacacataacagtagtttgaccgaaaaaatcacgaaagaaatggccgagtaccatattgcacccttgcaagtggctaacgacgcttagataacgtgataggacagttagcggtgaacggccgcgcttaatgggagatattgcggttcccattaggcacggcacaccgctgactgtcctatttttaataccggggggaatgtgaagatgagttgtcaaaactgtggttaccaaaattcaccgcatgccgtgacttgcctaaaatgtggtcatcgtctaacgccagtgaatggtgatgtcaatcagcaaagccgagtccagcggcggcgtcaacaatcacggcggacaactttttcgagtcgctttaggccacaaacactccttggggtattaattgcggggttactattgctgggtggcggctatatcgtgggacaactattgtggtcgtctacaacatcggcaactgccgagtcggcaggtaaaagccaggtgcataagccggctgccagcgattctgacgcaccgatgaaggcaacacagacatttccgactacgacagttactgatctggttgcgcaagcaacgaatgggttggctggtcaaacttcggtagcggtgatgccattaacgggtagccagaccgtggttttgaataatcgagcgcaacgtgctggcagtttgatcacgttatttattatggtcactgcctttgatcaggtccatcaaaataattggcgcatgcaggatcgttataccctgcgtgctgccgataaagttggtggaaccgggacgttgcacacgttaccagctggaagccagttgacgtatgctgaaatcacgaaacgcatgattacggagagtgataatacggctgctaatatcatgttggatcgtgttggcggcttctcggcggtcaacacggaaattgcacagttgggtctgactgatacaaaaatggctcggcggttaatggatactgccgcactaaaggccgggcatgataacgatacttcggttcgggatgtggcaacggtgctgaaacgactggcgaacctgcgtttgatctcgaacaaagccgatcacgcgatgttaacgattttgaaggcgaacacggatcacagtaagttggtcaaaaatctgccaacacgcgcgacgatctataacaaaactggggactatcaagcatacggtgttcaaaatgatgcggccatcgttcagaatcgtcagggaacttttatcatgacgatgatgactgctagtggggaacgtaccgcgcaaacggtcgcgatgaatgatcttggtcaggcgctttaccgggcaattttagagcagtaagcggtatgattttggcaaatagtaaaaaatcggccagtgaggtaagtaacttcactgagccgatttttattgtacgtgtatcaaaagattactttttctttggtttaggagctggcttattttccaagtcagtccggacaacgagaacgtcacaaacagccatccgagtgacatattcggtgactgacccgatcaataagcgttcaaccgcgttgagaccagttgcgccaatcataattaaatcgatgcccatatccttaggaacgtcgcgcgcaataatcgtcttaggtgcgccatattcaatcgaataatccacgttatctaagccgtccgccttagcttctgcaacgtacttgtccaacgttttttgagcagtatcggtcacttgttcaaccatggtcgtatcaaaactagaaatgttttggaaagcacgggtatcaaccacgtggaccatgtgaactgaggcgttaggtccgttccgtttcgcgacggcaaccgcctttttaaatgctaattccgcttcataagaaccatcaacaggaactaaaatgtgttggtattgttgtaacatcattctcacccctcattactttataactatattgtaaaggttttcgcaaaaaataaaaagcgttttctatgagatttgcatgaaactcactaaaattagtgcaattgccatcataatcagtgaaccgctagccagtacaatggcaattagcattgtcgcttgaacaaagatggtcacgaaacaggcgatggtaactagtaacattaagccgccaccatagcgtgcgacgtgtttgattgtcggcgctttgttcgggtcaaaaaagagaaatggtcgggactggtgcgtcagcagataataactgagccaacccgcaatgagcgtgtatatgacaagcagtaatgtaatcaaaatgaacctccaacaggtgatgttaatcttattttagttgattccggaagagaagacaaatgcaatgctagctaaagataagcgattagtactagtagttcacacaacacaatttagcgtcaaatgattgcgacacacgtcatgctggttttatgaggatgagtaattgttcaggagtgccggattgttgcagaaatacccaaaccagcgtgatggactgtatttcagtagccgagattagtcatgtataaccggcttcccaattaaccattctccccatgagttttggacggtgttagtaaaatgacgttgtgaacttgggtcgctttcacgccacaaaaaaaggccaggaacaagtcctgaccaacggaagtaaacttccggaaaaactagtggtgccgttaatcgcccttcagtattgacccgctttaaggcaggtgggacgttctgactaattcgctaactaccaaaggataaggcatgttatggaattagctaacggacatcccaaagtagtattaattgttcggcaacactttgtttagagcaatgcgcacaccttagtaatttcgactcttagtctagcatataaaaataaaagttgcaattattagcacaaccaaggtattgttagcgatttctctcgttagcctttaataatttttcgtattgttgcgcaagggctgtttcgtagcggccatttgttttgggctcgtaatacttggctgatttgatggcatctggtaaatactgttgagcgacccaatcacccgggtgatcgtgtggaaaatcgtatccaacaccatgaccgagtttggcagcgccttgataatgcgcatccttgatgtcggccgggatatcaccgaaatggccgtcacggaccgttgtgagcgcggcatcaatggcactgatccctgaatttgactttggcgataaggctaattcaatcacagcgtcagctagcggaatccgtgcttcaggaaatcccaattgatcggcagcttgaacagctgcgacggtgtgggcacatgcggctggattagctaatccaatatcctcataggcaatcaccatcagccgacgcataatactctttaaatcccccgcctcaactagccgggctaagtagtgtaatgcagcgtttacgtcggaaccgcgtatggacttttgaaaggccgagatcacgtcgtagtgggcgtcaccatctttatctgcggataaggctttcttttgcaagcattcttcaattgtttgttgtgaaatggcgatggtgccgtcatcggccggagacgatgataatacggccaattctaacccattgagggcactgcgcaaatccccgttggtagcggtgcacaggtggtgcatggccgcgggtgctaaatcaacgtggtaactgccaagaccgtttttttcgtcagcgagggctcgttccaccgcgtgctgaatatcatcgtcagtgagcgggaaaacttgaaagatctgcgttcgactacggatggctggattaatgctaatatatggattttcggtcgtagcaccaatcaaaatgatgcggccactttctaagtgaggcaataaaaagtcttgtttagttttatccaaccggtggatttcatccagcagaagaatgaccgtcccgctcattttggcttcttcggctacgatttgaagttgttttttactgtcggtagctgcattcagcatgcgaaaagcatacttggtggaaccggcaatggcactcgcgatactagtcttgccagtacctggtgggccgtatagaatcattgatgatagtcgtttggctttgaccatccgggcgatgatcttgcctgggccgaccaattgttgctggccgacaacgtctttcagcgtttttggtcgcatccggtaggctaatggttgttgcatcgtttgaaatccctccttgcaaaactagtcccaactattatagcatttacaatgaaggacaccgaataatcagtttaacgaacaaaataattataaaggattgatcattatggaattagatgccgttggtaaggcaattgtacagtatcacttagtcccactcgttcatcaggctaatttaggactagaggtcaccatgcaccgggtggacgaccatggtcacttagcgacgacagcacacccgcaagcgtttggatcagcgcaacaaaatcatcagttacgtccgggcttttccgcaagtgctttaaagtttactacgccggtgcgtcgtgacattcctgcattgatggcgtatctgaagggcttgaataccgcagcacggcggtcactcgatgcggacgaacgactttggccactgtcgagtacgcctgtgttgccggatgatctaacgaacgtgccactggctgatgttgatcaagtcagctatcagcgtcgtcgcgacttagctcgtaagtatgagttacagcgattaatgacgactggtagtcacgtgaatatgagcttgaatgaagctttattcacccgtttatatactgagactttccatcagcagtatcacagttatgttgactttcgcaatgcaatttatctgaaagtcgctcagggattggtgcgcatgaactggctgattcagtatttatttggcgcttcaccacgcctagccgttacggatactacgagtcgtccacaacgcagtagtgttcaacatcccgatggtcgctacagtcaagtgacgggagactatacgtcaattgatcgctacgtggccaagttgacggcggctgttcgtcaacagcagctgttgtcggtcaatgattttgacgggccagttcggtttcggagtaatgggcagctagctacgatggcccggcagggggtctattatcttgaataccggggcttggatctcgatccaactagtccagtcggggtggacgcgaacgcggtggcatttgttcgtttgttggcgagttatttcgtaatgatgccggcacttccagctaagatggtatcccaagtcaacgctcaagctgaccaattgacccgtcaagttttgggtgaaaatccaacgacggctagtgctcaggctgtaccggctgttcaagttttagatgcacttgctgattttgttaaaacctatggcctaccaaatgaagatgccgtgttactcaaacagttgaagtcgcgggtcactgatccaaagaagacgctgagtgcgcagattgccatgcaagccgatccgttagcatgggcactcgaacgggctgcacgctatcaggaatcgagcaatgaacgtccgtttgaacttgcgggctttaccgcgctagatctatcgagccagcaactagcccagcaggccttgacgcggggagtgcaggtggacgttgttgacccacacgctaacattttacgattgactaagttaggacggtcgcaattagttgtgaatgggagcggaacggatttaaatccacaggcgctaacgaccgtactgacacataaagcagcggccaaacaaattctggctgagcacggggttccggtgccggcttcacagacatatcatacagctaatcagttgattgctgattatgatcggtacgttcaagctggtgggatcgtattaaaagcggcggatgagtcgcacaaagtaattgtctttcggattatgcccgaacgcggactgtttgaacaagtcgtccggcaactattcgagcaaacgtccgcggtaatggccgaggaagtggtagtcgcatcaagttatcgctttttggttatcgatggtcgtgtgcaagcaatcgtcgaacgaattccagccaatattgttggtgatggtcgctcaacggtcaagacgttacttgatcgcaaaaatggtcgagcgttgcgcgggaccgcttttaagtggcctcaatcagcgctacagttaggaacgatcgaacggtatcgcctggactcatatcacttgaccttagattctgtggtcagccggggaactcagatcttattacgagaggatgcgacttttggtaacggggcggacgtgctagacgcgacggctgatatgcatcaatcctatgtgcaggcggtggaaaagttggtagcagacttacacttagcggtcgctggggtcgacgtgatgattcccaatctctatgccgaattagtgccagagcatcctgaaatggcggtatacttgggtattcatgcggcgccgtacttgtatccgcacttgttcccaatgtttggtactgcccaaccagtggcggggcagttgttggatgcattgtttaaaaatgaagattaagttgcgattgatttaagctgtaatcatacggaattataccgaaaaaatgagcttgacaaggtaatcttgttaagctcattttttatccctggaaaacgcatttggacatttttagataaaatttacgtttaaataaatacaacagaaaaatatgaaaacgataccaaaaaatgttgacaatcaaaatataagcttgtattatgatgaatgaagaaagtagttctattaaggagggcgtaaatggcaacgatttcagacgtcgcaaagttagcgggtttgtcagtctcaacagtttcacgggttatcaataacagtccacacgtatcaagtaaaaagagaaatcttgttaaagcagcaatgaccgaattgggttacgttccacggccggccgctcggcaactgcgcgggtctaaaacgaatacaattgcggttacaattccacgaatcgtgaatccgttctttgcatatttggtagatgctattgaacgggttttagatgagcaaggttatagtacgctgattgttcagacttttggtcgaccagaagaagaggtgacagcattaaatttattgaaaaatcaacaagttgatggtgtgattctttgctcaattgaaaactcatgggcagttattggagcatatcaaaaatatggaaagattgtcctagttaatgagtatctaaaagaaaaagatgtccccgttattcgttcgaatcaatataagggtttttatatggcaaccagttttttatatgatcaagggtatcgtaaaattgcctatgctactggccgtaagaatatcgtgattacagaacgtggagaggattttgattcggaccggtttgcaggttttcaagattcattaaatgagcatcaattacgtttcaatcggcagtggttattcactggcgctcatacttttgaagatggtcgtaaaatattacaacaaatattgacactgaatgtacgacccgatgtgttgattgcggggagtgatgaagttgccatgggtgttgttcaagaggcagaacgatgcaaaattaatgttcctagtgccattggagtattgggcgtggacgaccagccaatgtctgcgaatctaaaaatcccgttatcaactgtacaacaatcggttaaaagaatgggacaagcagctgccgaagtcatgttaaaacagatcagtggcacagaaacgtctactgaaacagtatttgagctaaaggttattaagagagcatcagcctaatgctctttttaaaataaataatttggtatcgataccaaaagtggaggaattaattatgtcagtaattttagcacgggtagaccaacgtttgattcatggattaattgttaatcaatgggcacaagcattacaagttaaacggtttatggtggttgatgatgaattaagtactaacgaggccattaaagcaagtatgcggatgtctaagccagccggaactgggatgtctattatcaatacggaaaaagctattactaacttcaacgctggtaagtatgataatcaacgggtatttgttttagtaaaagaacccgctacattgattaagcttattgaaggtggcgtcgaaattcctaaagttgatcttggtattctatttaatgaaagcggtcgcaaaccagttacgaagtttgttgccttagatgatgaggaacgtcgtgatttgcaaatattggaacagaaaaatgtccctttggtaatccagtacgtgccaactgatccagaagaaccttttaaagcgtagacgaggaggaactaataatgtcaggtattcaaatattacaagatattcttattgttttgttagcagggtatatgacgattgatcagaacggtcttgtgattatgtcttggttcccggtaattgtcggaacgattactggtttgattatgggagatttacccactgcgttaactattgctgggacatttcaattaatgatgttaggtgtcgccgctttaggtggtgcgtctgcgcctaattacggattggcaacaattgtcggtatttttattgctgtacgaactggatctgggattaagtcagcgattgctgttgggttaccagttggattattagcaatccagttagaagtcattgcacggatcatcgtcaatttcttagcgcataagatgttaggtgatgttcaaaagcatgattttcagaaaatgcgtcgtgaagcctggtggggtccggccttgttcagtttgcaaactgccttacctgcaattctaattgttttctggggcgccgatgttgtcaaatttattttgaacgttgtgcctagttgggttacaaacggactaactgttgctggcggtatgttacctgtagtcggagttggcatgctattacggtatatgccagtcaaaaagttcctcagttacattattgttggctttgtgctagcggcatatttgaagattgatgtcttgggtgttgccttaattggatttgctgcagcttattggtacttcttaagcgagtccaaaaaggtcagtcaagtagcaacaaatgccggtgtggttgaagatgaaggggacgattatgatgaataagcaaccaacaactaagattacgaaaaaagatcgtcggcgggccgcggtacgctataattttatggcttgcaatatctttaattatgaatcccaaatgggacctgcggtggcttgggcactggcaccagccttacgaaaaatttatgatgatgacgatgagtatcaagaagcattagaaaatcattttaattattataattcgacaactgtaatgtcttcgctgattttgggtgcttcattagccatggaagagcgtgatggtattaaggctaagacagcagttcaatcattgaagacaagtttaatgggaccgatggctggtgttggtgatacgcttgtctgggtattgtggccgacaattatgggatcgatttcagggtatatggccttacaaggaaacccattaggtgcaatcgtttggttgattgcaaacattgttttttggtttgtgaaacttaaaatgtttgatattggctttaccagtggtacgaagcttattacgtcattgggtgaacgactaaatatttttacagaatctgcctcaattgtcggactaagtgttgttggcgctctggttgcaacggtggttaaaatttcaatgcctgttaaatttgcggtaggtaaagtaacgcttaatcttcaaaccggaatttttgataaaatcatgcctgcattgttgccggcattactgactttattaatttatcatttgttaggcaataagaaatggacaccaacaaaaataatcttactagttattgcaatatcactggtaggaacatttttaggcatctttaaggcataggggagagttgtgaattatgaaacgtaaaattattttagcatcacatcatcaatttgctagtgggctggctgacaccgttaattttatttctaataatgcagctgatattgttgctttaacggcatacatggataaccagccagtagaacaacaagttaaatcattaatggctagtattcctgcagaagtggagatcgttattttgacagatatgctggcgggcagtgtaaatcagcaattttttaattatcgaatgcgcccccacacacaaattattagtggcatgaatcttccgttagcgttggccattgcactagaaccgactgatcacgagttaacagatcagcgggtttgcgatttaatcacccaggctcaagaatcaattgtttcagttaatcaaatgagtatagaaatggatgatgatgatgaataaaacagagtggtggcggaagagtgttgtttatcaaatctatccgaaaagctttaatgacagtaatggcgatggaattggcgatataagaggtatcattgaaaagttagattatttgaagcaacttggtgtggacgttatttggctgaatcctatctatcaatctccacaagttgataatggttatgatattagcaattaccgagaaattgaccatcagttcggaacgttagcggacttcactgcattactagatgcagtacatcagcgacatatgcgattaattttggatttagtcgtcaatcacacatcaagtgaacatccgtggttcaaggcggctaagcaaagtacaagcaatcaatatcatgattattacatttggaaagatgggagtaaagaacagttgcctaacaactggggttcctcatttggcggctcagcttgggaatatgttgatcaactcggtcaatactatttacatttgtttgcaaagcaacagcctgatttaaattgggaaaaccctaaagtacgtcaggatgtatatgaaattatgcgtttttggttgaacaaaggcgttgatggttttcggatggatgtcatcagtctgttgtcgaaaaaaccaacttatccggatggtccggtcattcaaaataaagcgtatggcagttattattatggtgcagccaatgggcctaaaatccatgattatttacgtgagatgaatcagcaagtattaagtcattatgacattatgactgttggcgagacaccccatactagtgttgctgaggctgaaaaatatacggatgaacgacgtaaagaattaaacatggttttccactttgaccatatgcatttagattatgatgaaaatggtaagttttctacgagacgcttcaaattatccgcactaaaacaagtgtttaataagtggcaattaggcatggctgaacatcatggctggaatagcttgtattggagcaatcatgatcaagcacgtccggtaactcggtttggtgtcgatgatactgagtaccgagttaaatctgcgaagctgttggcgactgtgttacattttcaacaaggaacaccgtttatttatcaaggtgaagaactaggaatgacaaatgccaagttcacctcaattgatgactatcaagatattgaaacacataatatctatcaagactttattaatcataaacatctcagcaaagagtacacaatgaaggccatttatttgaagtcacgggataatgcgcggaccccgatgcagtggaccagcaaacataatgccggttttacaacgggaacgccatggcttagcgtcaatcctaactatactagaattaatgtggaacaagcgttaaaggataaagactcaattttctattattatcagcaactgatcaagttgcgtcattctttatcgattgtgacaacgggtgactttgagttgcttgatcccgacaatgaacaagtattttcatacttaagacgagatcagaagcagatactattagtcgccgggaattttaccgaaaaaccaaaaaaaattgttttgccaacagaactgcagaatagaccatgtgagaagatcattagtaatgatcaaaacattgcagaagagactaacagtgttgttttaccagcatatggtgctgttgcttatttgttcagtattgattaaatttaacagaggctaacagtgcaacaatcgagttgtccagtgttagccttttattttatataaaggattatagtcaatacacggtgtcgtgattgaaaacacctatttcgaattttatctaaatatctcttgttgaattcctggttgcctgttatactctatttagatatatatctaaataggtgattggaggtagcccgtatggcgttgaatacgacctttaaagcaattgcagatcctgtcagacgccagattttggaagatttacgccagaatcggcaatcggctggtgagattgcggctcatttcaagttaagcaatgcaacggtgtcttatcatctcaagcttttgaagcaagctggtttagttaccgtgaccaaggaaaaaaattatgtgtactatgagctaaatgcgagcgtatttgaggaaatgttgacgtggctatatcgttttagtccaaagcagggggatgaaaagtgatgacaaaaaggaacttgcagttgtggctgagctatattgttattctgttaccaatgagctacggcgtcgtgaattatgcggccttgcccgccaaaatggctattcattttaatttggataatcaacctaatggaatggccacaaaattattagtggtcgttggctttccaattatgatgatggcgtttcagctgatttgcgttggggtgacacggttgaatgccaatcataaggcaccggcgccacggtttgaacagatgatcatttggatcgtgcctgtactatcaagtgtgatctatgcgacaactatcagttataacttaggccatcaattggatatttggcgtattgccgttagtttgattgcctttattttcatggccatcgggaattatttgccaacaatcagtgcaaatcaatacgcgcagatgcaccgaggtggtcacacgattcggccaatgatttggcggcgtgttcgttattggttgggctatacgctagttggtggtgggatattgttactactgagtatcgtcacaacagcatgggtttcagtcagcctcatggggatcattgttgcggccttagttatcatgagtctttatggcactctagcgcgtaattaacgcagtcaaacgtaaaaaggtcctcatccgtgcgtggatggggacctttgttgtattaaagtaactttttgaatttatctagcaacccaggtgttttctcggcctggggtgttgctgatgaagtctgcgagggataacgctgcgcaacatcaataatatcttggttaatggcgcttgcagcagtgaagataagcgcgtaatcatcatcagcagtatggtagatgtcatccgttttgatagtgaatttgatattggcttgactagccgccttgatatacggcccaatcagttcctggtctaaattaccattaatatataattggtcatccggatggctcgtaaatgcttgatgaagtgagtcgacgtaattggcctgtttaatttgggcaacggtcactgcgacttcgacgcgttcccgaaaggtccccaggtacttgcgttgttcgtcgggatgcaactttggcgtcccgtgcatggccgtttcgatgcggtcaactggttgtttatctgtttcagccattgtctaacatcctttccttgatagtaattatcattgtagcatgttcctccaataatagcgaagggaaggggggtagcgttgcgttagtgaatgcggtatggttaatctaaattagttttggggatgataaaacttgtttacaaatcaagattttgaaatttttaatgaccagacgttagcgggccgcatgcatttaatcaaaacggtgatcgatcctaagttcgaacaggtcgcaccaacgattatagcgagtttacaaacacctagcgagccaccgttctacgcgcacgttgccaaacatttacggcgatttaagaatccaccggtagacacttgggtcgcttttagtcaaaacaaacggagctacaaagcctggccacattttgaattggggctatggcctgaccgtttgtttatctattttgatattttggatgagtgtaaaccggccgtgcaggcaaagatgcaactcgcagatttaacaccacttttgaaggccttgccggcgggctatgttatcagtaataatcatggggtgccggccacgcaacttgcaacaccggccaatattacgcaggccatcaagaaattcgatcagtataaacacagcgagttggtcgtgggccgcgcagtcttggtcggtgatccgttatttgaagatgctgatacgttgaataaattgatcatcacaacattcaaacaattattgtcgatttatcaaccggtcatggcggctgtgagtgctgagcgtcaggtctgaaattaacagaacatacaaaaaaaccgccgcaaacgcgacggtttttaaataccggaaattaaagtttgttgtagtattcaacgattaatgattcgtcgatatctgcttcaagttcttcacgttctggtaaacgagttaatgagccttcaagcttatcagcatcgaattgaacgaagttagggcgtgcaacaacggcttcaacagcaccagtgataacagccaacttcttggacttttcacgaactgagacaacttggccgacactaacttcgtatgaagggatgtcaacacgcttgccatcaacagtgatgtgaccatggtttactaattgacgagcttggcgacgagttgttgctaagcctaaacggtaaaccatgttatccaaacgacgttcgagtaagatcatgaagttaacaccatgcttaccttcgcgaatcttaccagctttgatgaataagttagcgaattgacgttcagttaaaccgtacatcatccgtaacttttgcttttcacgtaattgtgtaccgtattcagaaagcttaccgcgacgaccttggccatgatcaccaggtgcgtaaggacgacgagctaattctttaccagtacctgaaagggacattcccaaacgacgggaaattttccaacttggacctgtataacgagacataaaatgtttcctccaataattttagttggagtaaaataatccgatgtaagttcgatattcgttcagattggactgcaggtttcaccattgcagccgcaggttactaactgaccaaaatattggcaccaatctgttgacgagcttacccactcactgctgcattattttacacaaagagtagcataacacgtttaatactgattagtcaatgtgtgacgtcagaatcgccacaaattcggtcaattcagcttcgttatcagcattgaatcggtctaatgatggagagtcgacgtcgagtacgccgatttggtggccgtccttggtgattgggaccacgatctcagagttgctggcgctgtcacaagcgatgtggccggggaattgatggacatcggctacccgttggttcgtttgcgtttcaaaagcagttccgacgacaccagccccaactttgatgtgcatgcaagcgactttgccttggaagggacctaagtcgagctcgccagtttgttcgttaaataagtaaaagccggcccagttaaggtggtcataagtactgttgaggagggcactagcattagctaagttcgcgaccaggttagtttcttgaaacagtagggcgtcgagttgttggttcataagtgatgtttccgtggtagccatgtaaaaaatcctccttgaatgttaacaaattgttactgtccgttagttacgtctatgttataatttaagatagattttaattggattttcagaaaaaagcaaggttacggttctcaacagggtgaggcgcaacgcaattaaaacggaataaataatgtaaggggtattcgtatgcaagtagcaatcggcattgttgtggttgcgattgtcatctacgcggcggtcaaaggctttcaattttatatcgacaagcaagtccgtcaattgacggaacggcaacaggcgctagtcaagcaatcgcagaccacagatttcgaaaaaattgaacaactcggactaacgggcggatcgttagcgaagttggaagcgttgcagagcgctggtcaagaagttgataatgatcagttacccgccgttagtgagcaattaacggccattacttcgcaggcgcggggcatcagatttctcgatgctcagcagaatctgaagaaggttgcggccacattagatacgattgaacaacgacaggcagaaattcgtcagggcttgcaggccttagatgacgcggatgccgcgcaccgccaagcagtggctagtttagagaagaagtaccaaaacatacggaagacgttattatcgcaaaacttttcatttggtccgagcatcgacaaattggaggatcagttagctaacttagaaagtgattttgatcatttttccgaattagccaaggctggcgatcatgacgcggctgaaaaggttttggatcagttacatcatgatactggcactcttgaaatggatattgatcggattccaccgatttataaggacctagtgagtgggtttcctgatcagttagccgaactggctagtggttatcaacaattaacggctcaacattttcactttgaggtcgaatcgattgagccagaaatcaaagcgttacagcaagcaatcgacgataatattgcgttacttggtgatttgaaagttacggatgctgaaaacggcaatcatgcgattgaaaagcggatcgaccacttatacgacgtgatgcaagcagagatcgatgctaaggccgttgttgatcaacaacaagaagaaatcagtaagttcttgacacatgccatgaatcagaatcaccgcttacaaattgagttggatcgattagcacaaagctatacgttgaataatggcgaagttgaacggacgcgtgaattgaacgaacaactgaagaatatcgaagctgtttatcaggcggacgtcacagctattactagtaagcaagctgtctttagtgagatcgcagctcattttgccgaacaagatgagcagttgaaaggcattgaagaagaacaagtggcaattaacaaaggtgtggcgagtttgaccgctgaagagtccaaagcccacgagacgttgcaacggttcgattttgaaatccacgcgatcaaacgccaggttgaaaatttgaacttgcctggactaccgaaagactatttggactatttcaaagtagttgccaaggaaatcgaacggcttgaccatgatattaataagcttgtgatcaatatggacgacatcacgaaacagttgattgtcattcaagcggatatggcgaccttaaaggaaaagaccagtgatttaacggatgctgcggttatggcggaacagctcttacaatacgctaaccgttacaagacgaatcatgaagaggtgcaagaagccagcgtggaagcacaacggttgtttaccgagactcatgactacgcgcggagtttagaagtaattgcaacagctgtggataaggttgatccggggtcctataaacggattgaggacagttactatgcgaataaacaagctgacaagatgaacgatgaggcctgacgaggatagttgggaccgtccgtatgcacaattttagttagctgaaaataaccagctggtggtgattgttaaatgacaaccgccaccagctggtttttagttggcatcatgatgcaagtggtcgtgatggatctaagaagggtgactgcgaacggccaacaaaaatggtgtttaggacgcaattgtcgtgtgattaatcagaaatttgaaacaaaaacccttgtttcactagtaatatttggtataattgcaaagaattcttatcgaaagtaagtgcaatgcacactttcttggaaagagaaggcgtagtaatgatttattttgacaatagtgcgacgacgcaagctgctcctgccgtactgaagacgtatacaacggtttcccaaaaaatttggggtaatccgtctagtttgcataactttggtgaaacggcctttcatttgttggaacaatcacgtcaacaaattgccggcttactaggtgtgcaagcccacgaaattttcttcacgtctggtgggacggaaggcgataattgggttttgaagggtacagcgattgaaaagcgggcctttgggaagcatctaattaccacggcggtggaacatcctgccattcataattcgatggaacaattgaaggaacttggttatgaagtgacttacttaccggtcgatcaggaaggccgcatcaacgtggcggacttgaaagcggcaattcggcctgacacgattttagtgtcaacgatggcagtcaataatgaaatcggtacgattcagcctttacttgaagtggcggaactactgaaacaatatccgaaaattcattttcatattgatgcagtccaaggaattggtaaaggaatccagaacatgatcatgaatgaccgggtggattttgtgaccttttcagggcacaagtttcatgcgactcgcggggttggctttatttacgcgcgcaatggtcgtaagttagcgccattaatgaatggcggcggtcaggaaagtaactggcgttctggaactgagaacttaccagcaattgccggcatggcgaaggccctgcgattgttgctcacggatgaagatggtaaggtagctcgtgagcgagctatcaaacagcgaatctacgagcacattaagtcgtttcctaaagtgacgattttcagtcagccaacgacggggttcgcaccccacatactgtgttttacgatcaacggtgtgcggggcgagaccattgttcacgcgtttgaagatcagggcatttatatctcaacaacgagtgcctgctcatcgaagaaacacttggcctccagtactttaatggcgatgcacgtgcaagaaaacattgcgacgagtgctgtgcgggtcagcctcgatgagaataatacgctggcagaagctgaccagtttattaaagtatttgatcaactttatcaaaaattctcaaaaattaatgcagacgcataacggaaaggaacttgttcatgcagtacactgaaatcatggtacgttatggtgaactatcgaccaagggtaaaaaccggcggaactttatcgatagcttaggccgtaacgtacgcaaagcgttgcacgactttccagaactaaaggtccacgcgaaccgtgaccggatgcacatcatgttaaatggtgaggatgccgataaagtcatgggccgtttgaagctagtttttggaattcaaaacttttcaccaagtattcgcgtcgatgccgacatggatgccgtctatgaaacggcgattgcgatggtcaaagcccagtttaaaccggggatgacttttaaaatttacacacggcgctccgatcatcagtttgaatacgatacaaatcaaatcaatgacatgctcggtgggcaaatcttggaccacgttgacgggattcaagttaagatgaagaatccggacattgtgttacgtgttgaagttcggttaaacggtatcttcttatcatcagaaacgattcagggtgccgggggattaccggtcggcaccgctggcaagggaatgctgatgctttctggtgggattgattcaccagttgccggctaccttggcatgaagcgtggtgtggacatggaaatggtccatttcttcagtccgccatacacgagtgaacaggcgttagcaaaggccaagcagttagcgtcaacgctagcaagttactctggtagcgtgaagtttattcagattccattcactgagattcaagaagaaatcaaagaaaaagtgcccgagggttatcttatgaccgttcaacggcgcctaatgatgcgtttgatggacgccattacgcgtcaacggcatggtaaggcgatttttaatggtgaatcattagggcaagtggcttcacaaacgatggatagcatgattgccatcaatgatgtgaccaccttgccggttttgcgcccagtgatttccatggacaagacggaaattattaagattgccgaagatattgatacctatgacttgtcgatcatgccatttgaagattgttgtacgatttttgcgccgccagcacccaagacgcatccgaagctagaccgttcacggtcctacgaagaacggattgatgttgaaggactgatggcacgcgctttggctggtgttaaaatgactgagatcaagccgggtgaaaattatttgaatacacaagaagacgtttttgctgaactattgtaggtcaaaaacgggtgatattattaccctaaaaacgagtacccggtaatactgggtactcgtttttttgatcttttggatgatcaagcagggacgcgcggaagctcatttcgtaatggtaagtcagctaaataataggtcataatcagcgaaccaaggtcgtgactatgctacgataaatttagattgaatcagcgaggtgagtggatggagtggcaacaattattaatggaaaatacggcgttgatcaatgcacaggttgttcagattgggctggaacgggaaggccagcgggtaacggtgaccggtcatttggcggatacggcattatcaccaacacttatcagcgagttgtccggcctgcaacgggactttgcggagacacagttggagttagtcacccaaccgcaagcaagtgcggttgctgcgttgcacgccttaacgatgctcacacaacaagtccggcaaaggcttctgcctgaactgatttggccgctaagcatgccgcccacacttccacgagaagaccgggatattccaattgctaagttggatgcggccgctgtcgcctatcgacaaggacttgctcaccgctatggccgacgacgtcaaatgttgtcaggtgttcactgtaatgtgagcttggcggctagtctgatgatgggattgtatcaggcccagacagatagtcgtgatttcaccacctttcaaaatcactgttacctgcacattgcgcagaattatttgcactatcgctggctactgacgtatctttatggctgctcaccacgctgctggccacagtctggtcttacgccaccagcccagcccgttcgaagcttacgcaacagttctagcgggtataccaatcggccgggtgttacggtctcgtacgcgtcgttaaatgattattgtcaaacactgcaagcggccgttgataatggaaaattaagtgcgaccaaggaattttacggtcaggttcggttgcgtcatgctggtggtcattcacaactatgtcaggatgggattcaatacttggaattacgtaacttagatctgaacccatgggccggtgcgggcatcgatctgtcccaactgacctgcttaacgtggttcgttttactgatgctctggttaccagtgccagctagtacggataattggattcaggcgggtcagcgcgccaacgaacaagttgccatcgaaacccccatgcaagtgactcgacagctaactgaaggcgaacaactagctgacgcgctacaaactatggctaccagtttacatcaaccacacgcgttgcaagtcgcccaacatatcttaactagtctgcacgacccggccaacacactcgctgcccgctgggaacaacaaacaaacgattcgctcgaacgtgcaacccaacttgcactccagctggctacgacaccacattttaatgcttgaatatactgaaatcggcgtacacacatgttggcacgttaggatgcgcatcggctgacgaacagcaaaccaactaataagcacgtttaaaccatgactaacgtcaaataacgcatcgcatgtcaagaatgataatttttgagacgattatttgcgcggaaactgaaattgcgttaaatttgagctatactattactaccacaaatattagaaaaccattagttatcgaaggggtgttttacgtgcaagtattatttcatgatcaagcgttagacttagtcggtgaaccgttacaagatggtgaccagttaccgaagttcaaagtgttcactacccatgatgaaaagattaagactaaggacttgctaggtaagcctgtcttgttaagtgtgatgccagatattgatacgcgagtttgttctattcaaacaaagaagttcaatcaacaggctgataagtacccccacgttcaatttttagccatttccaataacgcggttgctgaccaagctggttggtgcgctaaggaaggcgttaagaacttaacggtggcttccgatgaagaactatcctttggttacgccaccaatctatacttgcccaacaatgggacgttgacccgggcgatttatgtcgctgatgcggccggtaaaatcgtttatcatgaaatcgtgccagatgttagtcacgagccaaattacgttgcggcactggatgccctaaaacaattcgaataaggattgacggcactcaggaaattcattacaatagtgacaaccagcaatgagcaagagagtagcgataaacaacgtcaacagagagagcgtgaacagtgaaacacgcttggcggttttagcgtgaaggtagcttgcgagctgctattctgaactgttttagtaggaatagccggacgggatacaccgttcgttaacaacgatgtttaagttgtaaagcgatcacttgtgatggctttaaaattaggtggtaccgcgaagtccattcgtcctagtctaataggatgagtggacttttttagtgccaaaagaaaggatgtgccccaatgtcagaagaaccaactactgatatgccaactaagtatgatccgaccgccgtggaagcgggtcgttatcagacttggttagaccaagatttatttaagccttcgggcgacaagaaagctaaaccctattcaatcgtgattccaccgccaaatgtcacgggtaagttgcatttaggccacgcttgggataccacgttacaagatattattattcgtcagaaacgaatgcaaggttttgatactttatggttaccaggaatggatcatgccggcattgccacgcaggcaaaggttgaggccaaactgcgcgaacaagggatcagccgttacgatcttggtcgtgagaagtttattcaacaagtttgggattggaaagacgaatacgcgtcgattatcaaacaacagtgggctaagatgggattgtcattggactattctcgtgaacggttcaccatggatgatggcctgtcagatgcggttaagaaagtcttcgttgatctttacaacaagggcttgatttatcgtggtgaatacatcatcaactgggatcctcaagcacggacggctttgtctgatatcgaagtgattcataaggatgacaagggtgcgttctaccacgtcaagtacccatttgctgacaaagactatactttcaatggtaaacattacattgaaattgccacgactcgtcctgaaaccatgatgggcgataccgccgttgcggttaatccgagtgatgaccgttacaaggaattggttggcaaaaaagtcatcttgccattagcagaacgtgaaattccaattatcgccgatgcgtacgttgaccctgagtttggaactggaatggtgaaaatcacgcctgctcatgacccgaatgactttaaagtcggcaaccggcatgatttgaaacggattaacaccatgaatgatgatgcttcaatgaacgccaatgcgggtaaatacgaaggtatggaccgttttgaagcacgtaaagcgatggtcaaggatcttgaagatcaagatttgatgattaaaatcgacccaattgtgcatagcgttgggcattctgaacggactgatgtccaagttgaagcgcggctctcaacccagtggtttgtaaagatgaagccacttgccgaacaagctttgaagaatcaagagggtgacgatgccgttgactttattcctaagcggtttgaagatgcctttaagcagtggatggaaaacatccatgattgggttatttcacgccagctctggtggggacatcggattccagcttggtataacaagacgaccggtgaaacgtatgtcggtgttgatggaccaaaagatccagaaaactgggaacaggatccagacgtgttggatacttggttctcaagtgcactttggccattttcaacaatgggctggccaaacactgatgcggaagactttaagcgctatttcccaacgaataccttagtgactggctatgatattttgccattctgggtttcaaggatgattttccaaagtcttgaatttacaggaaggcgaccattcaagaatgttcttttacatggcctgattcgtgatgaacatggtgttaaaatgagcaaatcactcggtaacgggattgatccaatggatgtgattgaaaagtacggggccgatgcattacggtggttcttatctaacgggtcgacggccggccaagatgtgcggttcagctatacaaagatggatgctgcatggaactttattaacaagatttggaacgccagccgttacgttatcatgaacctgggcaccatggacaaaccggaattaccagctgcaagtgactggacgttagcagataagtggatcttgagtcgtttgaacgcgacggtcaaacaagtgacgactacctttgataagtttgactttggtgaagctggtcgagccttgtacaactttatctggaatgacttctgtgactggtatatcgaaatgagtaaggaagtcttgaccggtgatgacgctcaagccaaggccaatacccaaaacgtgttagcctatgtcttggatcaaatcttacggttattgcacccaatcatgccatttgtgaccgaaaagatttggttatcaatgccacacgttggtgaatccttagtagtcgctgcttatcctgttgaccatcctgaatttgatgacgaaacggcggaaagtgatatggcctcacttattgaattgattacggccgttcggagcattcgagcagaagctaatgcgaagatgtcatcagccgtggatctattaattaagacggacaacactcggttacaagctgttttcaaagctaatgaagattatattcaacggtttgcacatccgaagacactgtcaattggcgccgacgtggttgcaccgaagttagccatgacacaagtgattagtgatgcggaagtttacattccgttagctgaacttgttgacctcgatgaagaagtcaaaaaacttgaaaaagaacaagccaagtttgaaagcgaagtcgcacgggcgacgaagaagttaggtaacgaacgctttgttgccaatgcccctgaagacgtcgttaatagtgaaaaagagaagttagcggacaatcagacaaaactagctgccttaaagcaacgtttagttgatattaaggctgaagcttaatttgcgataatagttaactgaaatgtgtgttactggtaaaatggtaatcgtcccgttttgggatggttaccattttattattaaaacgtaaaatataagggctcattagctagaagtatggtgagcaaacggccaaatgatgattcgcgcggtttacaggaaggaagaccaacatgattgacacttattcagcagcattagcctttattcacggccggactcagttcaaaaaagccccgacactcagtcgtatgcgccaattcttacatgaattgggtgatccacagttaaaggtggccggcattcacgtggcggggaccaatggcaaggggtcgacggttgcgaatttacgcgaattatttatggcagatgggctaacggtgggaactttcacgtcgccgttcattgttcgcttcaatgaacggatcagtgttgacggcacccccatcagcgatgaagaacttgttggtctggtgcaacagattcaaccgatcgttgccaagcttgacgcgacattggcaagtgggggccccacagaatttgagatcattaccgcaatgatgtttctttactttgctgctcagccaatcgatattgccattattgaagttgggttgggtgggttatacgattctaccaatgtttggacaccagccgttagtgtgattactacgatcggttatgatcatatgcaaattctaggtaatacattgacggcgattgcgactcaaaaagcaggtatcattaagacgcaggtgccggtaattgttggtaaattaccggctgaagcacagcaagtgatgattgataccgccatgagcaaacgggcgccgttgcggacgttgggagttgattttacaaccaaattattaccgccccaaggctggcaagaacggtttaactttgacgggttagaggcgcattttaaagacttgacaactccgctactgggagactatcaagttgataatgcggccgttgcaatagcggcgtacctaacttaccaccaagcgactcagctacccgtggtcactagcgacgtcaaagcggctgtggcagcaacacaatggcctggccgtttcgaacgcttgaatcaggacccactgatcatgattgacggtgcgcacaatgagccggcagtaactgaattagcagctactttgagtgagcgatttggacagcaaaccgtttatgtcatctttgcggtcttagcggataagcagcatcaacaaatgattcagaccttgggcgcattacctaatgttcaattacggttgacacaattcgaaggcccgaacgcaaaacgtccagcgaccgacccgacgatgttggcacatgaaatgccaaatggccggaccgctgaagtatttgataattggcaagctgccttgatgcagacactccaagaaatgtcgagtgatgatgcgttactactaacggggtcgctgtactttattagtgacgtacgggcttatttcaaggatggcagcgactcagaaactgattaggggctgacacggatgcttagaagacaattgcgcaagaaataatactgcgtccctggtactgatattatcaaagatgattgtgagttaactgaaaaaattgcgttaaaatgtcggtgaattaatggttagccggtcactttacgaaactactaggtagaaagggtggtttcaatgacgatgatcagcgaagaacaaataccgacagcacaagttcgtgaattaatgcaagcctactttgggacgtttttacccaacgacgcggtgactagcgcgatgcaggcctttgagcgtgagtacccgatagaggacgctatagagtggttacatgagtcgtctgaaaatccgcgctggcaaggtttaatcgtggcgctcagatgtgggcaactattaccccggccaagtcgattaattttggggcaggtatatggtagtgaacaactgggagccgttttagcacgggactttgccaacttagagcaggaacagttgcaattgttatgcttagatacgaaaaatcaagtgatcaaacgccaggtcgtctttcagggcacgctcaatagttgtccggctcaaccgcgggaaattattaaagttgccctaacgacaccgactgcccgggtcgttattgcacataatcatccgagtggtgatgtgacgccgtcaaaaaaagacgttgaatttaccaagcggttacaactggcttgtgaactgatggggttaccgctcttggatagctttattatcggtgtaaacgattactttagttttgccgagcagggcgtgttaaattgtaatacggattcgtaacagaatgtggtaaaataacggggttaggaccgataatttaatcggcctgatcgcgtttttttgttaaattttatctaagttaaatagtgggactgtatttttcattaatttacggtatgctaggactcaggcaatgcttttttaatgcagtgcgactatgctataatacttactattatgactaaataaaaaattaaatttgttaatgatgaagggatgaatgtagtgttcggatttgggacaaagaatatcgggatcgatctcggtacggccaacacaattgtgtacgttgacggcaagggcatcgtattacgtgaaccatccgtagttgcgaagaacacgaaaactggtgaaattgtatcagttggttcagaagcacgggatatgattgggagaaccccagcaagcattgtggcgattcggccaatgaaggatggcgttattgcggactacgatacgaccgttgcgatgatgaagtactttattcaaaagacactcggccgctcaaatggtaagccatacgtcatggtttgtgtaccaagtggggttaccgaagttgaaaagcgggccgttattgatgcaacacgggttgcaggtgcgcgggatgcatatgtcattgaagaaccatttgcagccgctattggtgcagggcttccagtcatggatccaactgggagcatggtcgttgatattggtggtgggactaccgatgttgcgacaatttccttaggtggaatcgtatcaagtcgttcaattcgaatggctggcgataagatcgatgactcaatcatttaccatgttcgccagaagtttaatcttttaattggtgaacgcacagccgaacaacttaaaatcgactgtggctcagcttctttggaagccgctgaagacttggaagggtcaacgattcgtggacgagatcttttgtcgggcttaccaaagacggttgaaatctcatctgtagatgtttcagaagccatccaagaagtggtctctgaaattatttcagccattaaagaaacccttgaagaaacttccccagaaattgcctctgacgtaattgaccacgggattgttttgaccggtggtggtgccttattgaagaatctttccgaagtgattgcggacgaaaccaaagtaccggttttcatcgctaacgaaccgcttgactgtgttgcagttgggaccggtgaatcactcaagagcatcgacgttatgaaaaagcgataacaggtgagcgggaagacgtcttcccgcttatttattgttaaatcattgaattttcgaccgggggttcattatgcaaaagtttttttctaaccgaaaactagtgattgcgattgtcgtgttcattattagtttcggcttgatgagtgtctcagtagccattcgtgataagaaatcgacaccaccattgatccaacaattcggaaacgatgtggctggtgcggttgaccgggtgattgcttggccagtcaatggcttacaaagtgcgaccaactcagtttctgacttgttgaacacctatcaagaaaatcaaaaattgaagaagcaagttgaccaactggcgcaggccaaggttagtgcccagacgacgcgtgcggaaaacaagcagttacgcaagcagttgaaattaaataattcgttatctgattatacgacggtgaccgccaatgttttgacgcggacaccatcatcttggatgaaccaactcgtgatctctaagggtgcgacatccggtgtaaagaagaatatgcctgtcatgtcacaaaagggtttaattggccgggtcgtggaagttaaccaaacgaattctaaggttgaattaatttctaatacgagttcgtcttcgaataagtttgctattcagattacgaatagtgctggtaagactgttaacgggattatttcaggttatgataagagcaataatcttttagagatgggttccgtgacgtctaacgttaaaatcaaaaaaggcgataaagtcgtgacgagtggtttaggcggcaatacgccgaagggactttatgtcggcacggttgctagtgtcaagcaggatgattacgggctagcatccgaagtggaaatcacacccgcagcggaccttagtgacttaacagttgtgacggtcgctgaacaatagggaggtgcaacggtgcgttactcaagattaaaaatcatctttccaattgggttatttgttgcactctttttagacggctcggtgtcaaatgtttttgccggtaaactatttagttacccgtacgccagtgtcttacacctagttttactgtggattgtcttcgctgtctttttagatgaccgtgataatctgtcggttggaatttggtctgcattcgtgggcttggtgtttgactggtactatactgggattttaggcgtttacatgattggcttaccgttggtagtctatatatgtcgacaaatcaagccatggatcgacctgaactttttaacgttactgatgatctatattattaatttgaccattttggaagcatttacgtatatttggtacacgatgagccatgtgatctctagtgggttagcagactttgcggtgtacacgctaggaccgacgattgcggtcaacctagccatctttgtcatattatattatccaatgcgtcggttatatctgagtgttaattagtcggcagaaaggaattctaacatgcaacagagtgtagttttaaaggccagtaatgacggctatgaactgattttacggcaagaagcaagtttcgatgatattatggtcgacttgaaggtcttgttggatcggttgcaggctgataatacgactgataaacaaatctcgtttgacctggatacggctagtcgactactgactgcggaacaaaatcaaaaagtgacacagttgattcaacgatatccgttattcagtattcataagctaacggcagatgttattttgacggcggatgctttagcgatgattgaacgtgatacggtgcatctggttaatcagattattcgcaacggtcaggtcgttgagattacgggggacgtgttgttcttcggtaagatccatgaaggtggggtgctccgggcgacgggtagtatctttgtgatgggtgaggtaaacggtgcgcttgaggccggttatcccgatcacaatgatgcggtgatcgttagccccttagcgaccgtcccgcgggttcgagtcggtgaattgttagaattagtggaccttgaaaaagttgttgatgggacgaacgtcgtctatattaatgacattcaagcgttggactaccagccgctccagcaattaaaacgggtacgaccgaagctatttactcgaaatggaggacgtgtttgatgggaaaagcaattgtcatcacctctggtaagggtggggtcggcaaaacgaccactacggccaatttagggacggcccttgctttgatgggcaagaaagtttgcttagttgatttagatattggattgcggaatttagacgttattttgggtctcgataaccggatcctttatgatattgtggatgtagttgccggtcgtgctcaaatacggcaggcgttggtcaaagacaagcggtttgatgacttattgtttttattgccagctgcacaaaatgcggacaaggatgcattgaatcctgaccaagttcgggcaatcgtagacgagttgaaaccagattttgattacgttttgctcgactgtcccgccggaattgaacaaggtttcatgaatgcgattgctggtgcggatgcggctattatcgtctcgacacccgagatttcagcaattcgtgatgcggatcgggtcgttggcttattggaacaatatccgttagccgaagcacctaagttagtgattaatcgaatccggacgcgcatgatgcaagatggtgagacgatggatattgatgaaattacgcatcacttatcgatcgacttgctaggaatcgttttcgatgacgatgccgtcattcggacttcaaataacggtgaaccgatcgttcttgatcctaagaatccagcctcacaaggctaccgcaacattgcccgccgaatcgaaggtgaaacggtgccattaatgaatttagatacacctaaaccgggtgtttggtcacgaatcgccggaatttttcatcgtggcaagtaaaaaaggcttgacggttgattaattttcgattagtatgaactcaacattaaaaaacagggaacagaagagtagttgtaaggaccttgccgagcgagttatcgatgatgggaagatgaccaaggattacaacgaaccacatctgtgagttggacagctgaagttagtaagctgtttcggttggcctcgttagcggcggagtttagtgataaactcgttgagattagttgtgtgagcaactagtgaatatgaggtggaaccgcgattaaatcgtcctcttaggcatgctggcctaaggacgatttttttattatcacaaaactccctgaggtaataactgtgaagttattacgaagtgaggtggcaccacggataaccgtcctcttgagtattcgactcaaggggacttttttgtgtacttgagtcgtgaccgattagtggacgcaggacaatgtgacctgtaaatttgggagggaaagtacatgcagtatattttagaaattttgccatcattattatccggtgccgttatgacactgaaaattttcatttggaccctgattgggtcgctaccattggggttagttgttggtctgggattaatgtctaacttcaaaccgctgcaatggttattgcatttctacgtttggttaatgcgtggtaccccgttgttactgcaattaatctttgtcttttacggcttaccgttgattgggattgtttttccacggtactacgccgcgttattcgcatttattctgaactacgcggcctacttcgcggaaatcttccgtggtgggttacagtcgattgacaatggtcaatatgaaagtgcacgggtcttgcggctgagctactggcagacgattcgtaaaatcgttattccccaagtgatcaaaattgttttaccgtcagttggcaatgaagtcatcaacttggtcaaggattcatcgttagtttatgtcattggtctcggcgacttgttacgtgccggtaacgttgcgacagcgcgcgatgttactttggtacccttagtattagtcggaatcatttacttagcactgacagccgtaacgacttttgtgcttggacgaatcgaaaaacactacagttactggaaatagggaggccatcatatgttagaactaaaaaatattacaaaaagctttggttcacggacaattattaagaatttgaatttaaccgttaaggatggcgagattctaagtattgtgggcccttcaggtgctggtaagacaacgttattacgctgtattacggggcttgaaaaggtgaatgccggtgagttcttagtcgacggccaaccatttgacccctatactaatcggagtaacgatagtgtgattggtgttgtattccaaaattttgaattgtttcccaatttaacagtcatgcagaatattactttagcaccgaccacggtcttaaagcagtctagcgcagaagcagaacagcaggcgcagactttattagatcgtttgaatctcggtgatcacgctgaccagtatcctttcgaattatcaggtggtcaaaagcaacgagtggcgattgcccgggcattagccatgaaaccgaatgtcttatgctatgatgaaccaacttcagcacttgacccgaacttacgacaggaagttgaaaagttgattttaggcttaaaggctgatggcatgactcaaattgtggtgacccatgatttaacctttgctgaaaatatcgcggatgaaatgttccacgttgaaccaaccaagaagcaataggggggcgtcagaatgaagaaaagattatttgcactcagtttgatcgttgtgatgctcctgggtatggcaacgacgttaagtggctgtggtcaaaatgtgactaaacgcgctgacacccaagatacttggtctaaaatcaagaaacgcggttacgttgtcgttggtttggacgacagttttgtcccgatgggctttcgcgaaaagtctgggaaactagttggttatgatatcgacctcgcccgggccgtctttaagttgtacggtattaagatcagctttcaaacgattgactggtccatgaatgcgaccgaattgcgcaatggcacaattgatttgatttggaacggttacacgaaaaatccccaacgtgaaaaagtggtggctttcagtaatacttatttgaagaacaagcaagtcctcgtttctttaaagaaaaatcatattaactcatttgacgatatgactggtaagtcgttgggtgttcagtcaggttcttcgggctatgagtcattggaaaacaatccgaaactgctgaaggataagattgctaagaaaacgccagttcaatacgataccttcacgaatgccttcctcgacttgaatgctggacgaattaaagggctcttgattgatagcgtctacgcgagctattatattaagcacgaagcgaactctgcggattaccaagaaacgcaaggcacctttaagtcggaagacttcgcagttgggatgcgtaagggtgacaaaacgatgaaacgcaaaattaatgccggcctaaagacgttgaaggctaacggaacgttagataagatcaacaagaaatggtttggtaatcaaaaagttgaaaactagcgtgacgtggcaggacttgtcattcagtgaccccagttatcggtgagcaactaatcataaataggctttccaagacggacgatgtcttggaaagcctatttatattggcacgcagacaaactgggattgaaggcttaaacttatacacgaaaaattgttgaaaggtgccgctataaggccaaaaacaaccagctaaggcccgctggaaaaagttcgagttttgcataaacttgcttggctagcgtcgtcctaagccgacttccaggcatttctgccaattgctggaacgcggtggacacagatttaagccgaagaccacgtcttaaatactggtcttccactaaccaagcaaagaacgcttgctaagtggaatttcaccgctgagcattggccgaaatgccttccagtcgggacagtattcgaatggcggacgaagatgtacctaacttgtgatggacttgtcattactttttataaacgataactttgtcaagcaacggtcagacagaaaatgatattgttatggttcactatttctgaaccaatgtagcaataattgaacttctcgataaacatagagatttacacctgacgctttatttgaagctccggtattaaaagaccaattacaccaagttaagtggccgttaatcagccattcgagcggcttaacgaaacgcgcgcggtgacgctgaatcctgtgcttgctacgccaacggactgatgcccaaaccgcattaatccgttgactaggcaatgcttaaattcaacccgtgatccctcgcacactttagactggaggggttgggtgacaatgctcagtagccaaattattcttagctgaaagtgggttgctttcggcttagaataagactcgtatttgagatgatgcgggttgggcattagctcaaatcgacgtcggctgcgttccagcaattgtcacccagccccggaggtcggaataggacacgtacatgctgacgaacgagtatccggggtcaattgccggcacctttcaacaacaattgatgaaaaacacggccataaaaaatgcccgactagttgactagtcggacgtatgggttaatcgaaaaattctttatataacgcaataacggcttgatcggcatcattgtcgtgtacaccgaacataatagaaatttcggaggcgccttgattgaccatgattaatttaatattgtcgttggctaatgcggtggcggcacgtgacatgatgccgacgcggttgcgcatgttttcgccaacgagcattaagattgagtagtcgtgcgtaaagtaaatttcatcgggattgatggccgctgagatttctgcaactaacgttttctctaattcgggcgtcaactgatgttcatcaaagatgatggtcaaatcatcgatcccagatggcatatgttcataactaatatgatgattttctaaaatcgttagaattttacggcccagcccaacttctttgttgagcagatacttacgtaagtatagtgaacaaaaactagaagaactggcaatcccagtcaccgggtagtggggattgggttcgcgagttgactgaatcaaagttcccggggcctcgggatggttcgtattcttgacgttgacggtaatgttgccttcgattgctggaatcaacgcttcgtcgtgaaagacagaaaagccagcgtaagaaagttcgcgcatctcagtaaacgtcatttcactaatggccgctggttttgcgaccaaactaggattgaccgcgtaaattgcatcgacatcggtaaagttttcataacgttcagcatggacgccccgagcgatgatcgcaccagtaatgtcggagccaccgcgtgaaaaggtacaaatttggccgttacgattgtaggcgaaaaatccggggataactaggatttgttcgctgttggcccacttagcgagctggtcataactactcttgataatctgagcgtcatcgggaacgtccgtaacgaccattcccgcatctttagggtcaaggtagcgagcgttgaggccgctttgttggaaaacagcggcgaccagttgcgcattgagacgttcgccgtgcgctttgaaagctgccatcaagtaggtgttgtcggcgtatgattgttttggtaagttgcgaatcgtttcaaaaatcggagtcaattgtgcttcgggaacgttaaacccgtgaccgatttctgcataacggtcaatgatagctgcggtaacggcttgcgtatcttgatgatggatcgtttgacgggcatattgaataagtaaatcagtgactttggtgtcgccatcgaaccgtttaccaggtgccgatacaatcacatatttacgtttttgatcagcctcaacgatcgcgaggactttttgcagttgctgactactagcaagggaactgccaccaaatttaattactttcacattaaccgctccttaattttatcaataatgaaaagaatagcagacaaatcgcgacttggcaatgttaattgccactcacgagaatttaatttaatcgtgaaaataatcattttggcgaccataatctgaaaataaaaaaaacaataggacggaaagttgcgtcaatccggcctttcgcttattatttattacatatgcaaggaggaaacatgttgcaaactcagttagcaaaaggggtccaattgacgacggttcagagtcatcaatttaaaaccaaccagattattatcaattttcgggcaccgcttgcacgtgaaacaattactcagcggtcgctactatcgaatttattagaaacaagttctcgtgattatccagatcagcgagcgttagccaacgcattggctgccatgtatggtgctgcgtttggtgcgggtgttagtcgtaagggaccaacgcataacttgcaattagccatcaccgttgcgaatgaacggtatttggcaacggatcagccactgacaaatcaggccatccagtttttacaacaagtcgttttacaaccgctagtggcggacggtcagtttgatcaagcgacgtttgaccgccaaaaaaagaatttggaagcggcgattatgtcggtcgctgatgataagcaatattatgccgcacagcagttaaatacggcgttgtttgcggacgaacctgcgcaacaagtgccaagttacggtacggtgagtgatttggcagccattactgcggaaggtttgtacgactattatcaaatgatgatccaaaatgatcaaattgatattatcgtgacgggtgacgttgatgaggcggccgttttagctcagtggcaacaagctggttttgaggatcgactggcggggcgcccacggccattttatcaacatcataatacaaaccagtacgtcgaagtgagtgaacaacaggcactcagccaagcaaagctaaatttaggttatgatttgccagtcttttatcgtggcaatcattattacgcggccttggttttcaacgaactatttggtgggtcaccgctgtctaaattgtttatgaatgtacgtgaaaaggcgagtctggcttactatgccagcagctcattggatactttccgtggggtgcttaaggtgcaagctgggattgatggcaaaaatcatgaccaagtgttagcaattattgcggcccaattaacggcgattcaagccggtgattttacggatgatttagttgaacagctgaagctgggcttgatcaacgattttgagtccagtttggatagtcaacggacattcgctgtgcaagccttgatcgatgatttaacgcaacaacgcgttacggatactgaatggctacggcagattcaaagtgtgacgcgtgaacagatcattgcagtcgcgaagatggtgacccttaataatgggttcttcttgagtggggtaaccgcatgaaagtaaaaaaatatgatcaatttaatgaaagttgttatcaagctcagttggataatgggctgacggtgacgttgttacctaaggccggttatcacaaaacgtacgcaacgtttacaacgaactatggctcgatcgacaatacctttgttccagccggaagtactgaaatgcaacgcttcccagatggaattgcccactttctggaacataaaatgtttgagaaggctgaccatgatgcgtttcaaatttttggtcagtacggggcgagcgcgaacgccttcactagcttcacgaagacgagctatttgttctcagctacccggcacctgcaggacaacctcatgaccctcttagattttgttcaagatccgtattttacgccagcgacagttgacaaggagaagggcattattgggcaagagattgagatgtacgatgatgatccaagttggcgcctgtatttcggaatgattggtaatctatatccgaaccacccactacaatatgatattgcggggacgactgagtcgattgctaagataacggctgatgacttgtacgccgcttatcggacgttctatcatcctgagaacatgacgttatttgtggttggtaattttgatccagacgaagtgttagggtggattacgactaatcaagcaactaaaaaatttgctgcctttcaaccgattgaacgtaagattcctgaaaccgcaacggatggacatgacattattccttatcggacgattgatatgccagtcaatcgggccaaatcaatcgttggtgtcaaaggcttgctgccgattgaagcgggggctgctgctttgaagtaccgtgcagcggttaacgttttattagaattattgtttggcgatacgtcagcagattatttgcgattatatgatcagggtatcatcgatgatacgtttggttatgatttcgaattacagtctggatttaattttgtcacttttagtggtgaaacggatgatccagcccagtttgatgcagccatcattgatgtgctagaaaactggcggacggctgtagttggtcaggaagcagcactcgcattagtcaagaaggaaatgattgggcgggtcgtcttcatggcgaactccttggaggcaatcgcgaaccggtatgatcaacggctattcgggacggcgacaatctttgatgaaccgggtataattgatcagttgacccttgcagacttgcagacggttgctgaacaattattgacttctcaggcaatcagtgaataccagattcgaccacaagcaaagagttaaggaaatctgaaatttaatggtcatggggctgctaaatttagttgctgtgatatactattaaccgtaagattttgaaaatagacttagggtggagaaaaagtcaatgagtgaaaataacgaagaaacaacaacgattggggcgcgcttaaaggctgcccggacagcgaaaggcctcacaattgatgatttgcaacaaatcaccaagattcagaaacgctatttgattgcaatcgaagatgaacagttcgataaacttcccggtgatttttacgttcgggcgtttgttaagcaatatgcggaaactgtcgatttagatggtaacgcgttgttagaagaatatcgagaccaattaccgagtgttcatactgaaaccatcgttgaaaatgttgatgaagttcaacctacccgggttgctagtcgcgaacaacctgcttcaccagcgagtcgcgtacgtaactatttaccaacgatcatcgtcactgccattgtggttttgattttgttatttatttggtttatggcggttcgcacgcacgctggttcaagctctagcacgagtgcggacagttcttctgtacaagtttcgagttctaagaagcaatcgagttcgtcgaaagctagttcatcagcaaagtctagttctaaagcgtcttctgccaaggaacaaacaatcaaggctaacggcagtagcgatacggcttatactttgacgaatggtgcggataagaacaaagtggtcatcaagtctactaaggctgcttggacttccgttacgactaacggtactcagacttggcaaggaacgctaaaggcggatggctcacatacattaacgttaccaagtaatgctacgacggttaagttccagtttggaaacgcaactgccacgaccgtaacaatcaatggtaaggcgttcaattttaatccgaagaacagtacgtcacaagttcggacgattaccttgaccatcaaataacgttgcggaggaggcgggtactttgaatttacctaataaattaacggtgtttcggattattctgattccagttttcattcttattatggtgttaccccttagttggggacaggttgtgtgggctggaacaacaattccagtcacccaagtggttgcaactgtcatttttgcggttgcgtcattaactgacttagcggacggcaagattgcccggggtcaacacttggttacgaattttgggaagtttgcggatccactggcagataagatgttagtaatgaccgcgttcatcatcttagttcggttaaatgcggcccctgattgggtcgttgccattatcatgtgtcgtgaactcgcggtaacggggttacgattattgattgttgaaaataatggtaaagtgatggctgctgctatgcccgggaagattaagacaacgacacaaatgattgccatcatcttcctgctgctgaacaatgtcttatttgcggcaatccacattccatttgcggcaattatgttatatatctgcttattcttcgttatttattctggcattgattattttgttcagaatcgtgacgtgtttgcagatggcttcaaataaaattaatcatgagcgtctcaccgagtcttgcattcagtgagacgtttttgtataccattgtgttgccctattaattaatcatgactcctgtcagtcgataattttaacgatgagtcgcgttggcaggttatgtcaaatgaaggtatttgaaaatgctaatctttttaatggggtcgatcgtcattttcgtatatacttaatgtaggacgataatcatcgcgcccacactgagtgtaatcgataggattacggggaggcatatatggcatgcaagcagaaataatcgcggttggtaccgagattttactgggtcagattacgaacacgaacagtacgtacatcgcacgtggattggccgaattaggaattgatagctattatcaaacggtggttggtgataatcggcaacgtttgtcgaccgtcattgaaattgcggcccagcggaatgacttagttattttaacaggtggtttggggccgaccaaggatgacttgacgaagcagacgctcgcgcattatttgaatgttgccttggttgaagatcaggcagcaatgcaaaaaattacggcctggtttgccactaatgacaaagtaatgacggccaacaaccgattacaggcattgtatccggcaggcgcgcaaccgttgactaatcataacggaatggctgttggtgcgttttatcagtcagaaaatagtgctgatttcttgttattgccaggtccaccccgtgagttagccgtaatgtttgattctgaggcaaaaccgaaattggcagctgcatatggggaacaagcccaaatctattcgcgagtgatgcgtttttatggcatcagtgagtctgaattggcgacccggttgcaacccttgattgatgaacagcaggcggttacgatcgcaccctatgccaagactaacgaggttaccctcagattgagtgcccaagctatgacggaaacggctgcaaggggaatgatcgacaaagttgaccaccagatcaaggctaccgttgggccgtacttttacggttatggagacgataactcgttagttactactgttattaatcaaatgattgcggctaagctgagtattacagccgcggaaagcttaacagctgggctgtttcagagtaccatcggcagtgtgtccggggtttccgcaatctttccgggcggctttgtaacgtatgcgaatgaggccaaacatcagctagtgaacgttccacaagcaattattgacgctgagggcgtggtttcagaagcgaccgctaaggccatggcgagtggtgctaagcagcagctaaatactgatgttggtatcagttttacaggcgttgccggtccaggaaccttggaaggtcaaccggctggaacggtatggattggtcttgcttaccgtgatcgacccgtgaaggccaagcagtaccattttgctggtaatcgacaacaaattcgggaacgcagtgtgatggccgggttagacctattgagacatgcattgaatgaagatacggacttaaaaaaataatacgaacttttgttcgctttttgcttgcaattctaactttgaacagctatgatattaagagttagaaacgagcaccaaaggaggaaataatttggctgatgcacggaaagcagcactagatactgccctgaaaaagatcgaaaagaatttcggtaaaggggcgattatgcggatgggtgacgctgcccagacgactatttcaacgatttcaagtggatcgttggccttagatgacgcgttgggtgtcggcggctacccacgtggtcggatcgtggaaatctacggtcctgaaagttcaggtaaaacgaccgtggcactacatgcggttgctgaagttcaaaagcagggtggtacggcggcctatatcgatgctgaaaacgcactagaccccgtttatgcggaacacctaggggtcaacattgatgacctgttactttcgcaaccagatactggtgaacaagggcttgaaattgcagatgccttagtttccagtggtgcggtcgatattttagttgttgactcggtggcggccttagtgccacgtgccgaaattgaaggtgaaatgggtgacgcacacgttgggttacaagcgcggctgatgtcacaagcgctccggaagttatcagggacattgaacaaaaccaagacaatcgcgttatttatcaatcaaattcgtgaaaaagttggtgtgatgtttggtaatcctgaaacgactcctggtggtcgggccttgaaattttacgccacgattcgtttggaagtacggcgggcagaacagatcaaggaaggaaccaatattattggtaaccgtgtccggatcaaagtcgttaagaacaaggttgcaccgccatttaagcgtgccgaagtggatatcatgtatggtcaaggtatctcacaaactggtgaaattgttgatatggctgctgaaaaggatattgttaagaagagtggttcttggtattcatatggtgacgatcgcattggtcaaggccgtgaaaatgccaagaagtatttggacgagcatcctgatgtcatgacggagattcgccaaaaggttcgtgatgcatacggtatggatgcaactggtgaagaaacgtctgaaactgatgatcaggccaaagaagctaaggataagggaactgctaagaatggcagtaagggtcaaagtaagtccactaaagcgacaccagcggaaactgctctcgatctcggcgaccaaccaaccgaaaaatagacagtttgttatgcaacgcccaaaatatttattttgggcgttttttgtacatacttagcttgtttgcacgacaaaagtagcctgcagagagcggttgccataagactttaagttgacactattcgtttctaacattagaataacaagtgtgtaaataatcaaaatataacatctgaaaatttgtagttgattttatgttaactggattttggtggtgcggaggtggaaacatgaatgttttcggtataatcctcgcagtcatcgcaattgttgtcggttatgggattggttactatgtacgcaagaacgtccatgaaaaagaattggacgttgccaggaacacagccgaaggtattatttctgaggccaaacgggcagcggagactcataagaaagaaaaagtccttgaagctaaggaagagagtcatcgctaccgggctgaagttgaaacggagttaaagcaacgtcggaatgaagttcaaaagcaagaagaccggttgcttcaacgtgaagaaactttagatcacaaagagaatacttttgaaaagcgcgaggatgctttaggtaaaaaagaagataagattgccaatgagcaaaaacgcgttgaacaacagcaacaaagtgcagcttcactaatcacgcaacgtcaagctgagttagaacgggtcgccgccttgtcgcaagaacaagctcgcgatcagattttgacccaaacgcgcgaacaattaacgcatgaacgggccgtgttaattaaagaaaatacggacgaagtgaaagcgcagtctgaaaaagaagccaaaaacttaattgtccaagcgattcagcaaagtgctgccgatatggtttctgaaaccacggtttcggtcgtttctttgccgaatgacgacatgaaaggccggattattggtcgggaaggtcgtaacatccgaacgttggaaacgctgacgggaattgatttaattattgatgacacgccagaagccgtcgttttaagtggttacgatccgattcgtcgtgaaatcgcaaagatcgcgcttgaaaagctgattcaagatgggcggattcatccagctcgaattgaagaaatggttgaaaaagcgcgtaaggaaatggacgaaaagatccgtgaaactggtgaacaagctgtctttgatttaggattgcacgggatgcatcctgacttgatcaagcttgttggtcggctgaattatcggaccagttatggtcaaaatgttttgaatcactcaattgaagttgcgaagttagcgggcgttttagccgctgaacttggtgaagatgttacactcgcgaaacgcgcaggattattacacgatattggtaaggccgtcgatcatgaggtcgaaggttcccacgttgaaattggcgtggaattaacaacgaagtacaaagagagccccgtcgtgattaacacgattgcctcccatcatggtgatgtggaagctaagtcgattatcgcggtgttggttgcgacgtctgattcaatttcagccgcccggccaggtgctcggagtgagtcgctggagaattatattcatcggctcgagaagctggaagcgatcgctaataatgaggatggcgtcaagaagagctatgcgattcaagctggtcgtgaaattcgagtcatcgttaagccaaacgagatttctgatttacaggcaacggttttggcgcacgatgtcaaaaagcagattgaaaatgaacttgaatatcccggtcatattaaggttacggttattcgggaagttcgagcagtggattacgctaaataaccgggaaatgagtttaggtcttgacctaagctcatttttttagttgccagcagaattcaatcacgttttcaaggctaaataatgctaaaataattggtataacgttaaaacaagggagcaatctatgcgaattctatttgttggggatgtcatgggcaatgtcggccaaacggcggtcaccacgtacttacctaagttaaaacggcgctacaagccacaagttactattgttaatggggaaaatgccacccgcggccgcggcattaatcaggaagtgtataaggacatcttgactgcgggggctgatgtcattacgatgggcaaccacacctgggataataatgaaatctttgattttattaatggtgctaagaagttgattcgaccgttgaactttccgccagcgacgactccgggggttggttatacgatcgtgaaggtcaatacggtgaagttggccgtgattaatcttcaaggaaacgtctttatggggcaaaatttagcggatccttttacgactgtccaaccattggtcgagcaactgcgggaagagacacctaacatcttcatcgactttcacgctgaaacgacaagtgaaaaagaagccatggcgtggtatttggatggtcaggtgagtgcggtagttggcacccatacccatgtgcagacgagtgatgaacgcgtattgcctaatgggacggcctttttaagtgacgttggttttacgggtccgtataatggtattttagggatgacccgtgagaatgttattcagcgtttcttggaacaaatgccgacccgtttcaacgtgcaagaggatagtccggcagtgttgtcgggttgtgtgatcgacgttgatggtcagagtggtcgggcgaaaaagattgcccggattttgattaatccggatcacccatattttgatgactaagatttacgatagaaagtaggattaagcgtgccacagaaaacaaaagatacaccgatgatgcgtcaatattttgcagttaaaaatcaatatcccgatgcgtttttattttaccgacttggtgatttttatgaaatgttttttgatgacgcgattaaaggtgctcagttattagagttgaccttaacgacgcggaatcattcggcggaaaaccccataccgatgtgtggggttccccatcgagccgtgcaaaattatattgatattttagtagataaaggttacaaagtcgctatttgtgaacagatggaagatcccaaattagccaagggcatggtcaaacgcgaagtgattcagctcgtgacacctggtacgacgttggaacggggcgcggaacaagctaagacgaacaattacttgactgcgctgattcagcgtgatcaacaatatggttttgcgtacgccgacttgtcgactggggaactaaaaacgagtgtcttaacgactaacgataccctaattaacgagttgaccagcttgcaaactaaagaaattgtggtcgacgactctgttgctagcgatttgcgcgatcaaattaagacgctaggaattctaatttcagaacagaataacgtcaccccccaggctgaattgagctacttgactcaggacttgacggtcgatttggaacaacaggtcgtggaacggttattgatgtatattacggtgactcaaaagcggagcctcgcgcacttacaaaaggcgatcgcttatgagccgtcatacttcctgaaactcgatcataattccaagtataatctggaattaatgaagtccatccgaactggtaaaaagcagggaactctcctgtggctattagatgaaactaagacggcgatgggcggacgactattaaagcagtggatcgaccggccattgattgtgaaggccgatattgaaacgcgtcaaaataaggttgcgacgttattagatcattattttgaacgtagtaacttacaagaagagttgactaaagtttatgacttggagcgtttagctggccgggtggcttttggtagcgtgaatgggcgtgacttagtgcaactcaagacatccttgcgtcagattccaaagattcggtatatcttatcggaattagatacgcaggtatttaatgatgaagttaatcagctggatccagtcgaagacgttgcggatttgattgacgcggcaatcgttgaagacgcgcctttgtcagtaacggacggtggtgtgatcaaggatggttataacgagcaactcgatcaatatcgggatgctatgaataatgggaaaaaatggattgctgagttggaagcccaggaacgggcgacaaccggtatcaagaatcttaagatagggtttaaccgggtcttcggctattatattgaagtcacgaaggccaacttggcccaattaccgaaggaccgctatgaacgtaagcaaacgttaacgaatgctgaacgctttagtactcctgaactgaaatcgcatgaaagcctaattttagaagctgagagccattctacggatcttgagtatcaactcttcacaaaggttcgtgaaacggttaaaaaggcaattcagcggctacaaacattggcgaaggcggtcgcagcaattgatgtcttgcaaagtttcgccgtcgttagtgaagattaccactttgttcgaccgaaattaactaaatcacatgatttgaagatcgttgatggtcgtcatccggtcgttgaaaaagtgatgggcaaccagagttacgtcccaaataacgtgacaatgtcacctgatgagacggtccttttgattactggtcctaacatgtccggtaaaagtacgtacatgcgtcaattagcattgacggtcatcatggcgcaaattggttgttttgtaccggctaaatcagcgcaacttccaatttttgaccaaatttttacacgtatcggtgccacggatgacttaatttccggtcaaagtacgtttatggtggagatgcaggaagccaataatgccttgcaacatgcgacagccaatagtctagtgttgtttgacgagattggccgggggacggcgacttacgatggcatggcgcttgcccaagcaattattgagtttgtgcataaccatattcatgccaagacactgttctcgacgcattatcatgagttgaccgcgttagatcaagaattatccgggttacgaaacgtgcatgtgggtgcgactgaacaggatggcgagctcgtcttcttgcataaagttgagcccggggccgccgataagtcctacggggtgcacgttgccaagttggctgggatgccaacgagtttattggaacgggccaataagattttaacgagtttggaaaatcaaacgagtacggtatcgacgacagcggcttcgattgctgctagtgatgctgctaatagcgtggcacctaacacagcggcttcaatgccggttgaggccgccgatgagtcacagccagtagaatcggagaccccggttgccgaagctccggtcgctgaagccggtgatgaacagctgtcgttatttgctgagccggcggtgacggatgcgaagggtgaaaaggttttacaacagctgaagacgttgaacttgatggcgatgactccgatggatgtaatgaaccagctgtataaatggcaacaaaaattaggcaagtaggcgcattttaactcatcataaatgagcgcaataagctgttattatgatgagctattggtgcgtctgacggacaggtaggtcgacactagtcagttattgctagttgtggtaatcgaaaatgttcgtgcaggacacgagcttaattattttatgtgaaaggaccgatggaaatgggaaaaattcatgagttatcttctgtgctggccgaccagattgctgccggcgaagttgtggagcggcccgcctcggtcgttaaagaactggttgaaaatgctgttgatgcgcacgcgacgcaggttgatattttggtgcaagagtcgggtgttcagtcaattcgggttatcgatgacggtgacggtattgatgacgctgaagtcctgaccgcttttaaacggcatgcgacgagtaagatcacatcacgtgaagatttgtttcgcgtccattctttaggttttcgcggtgaggcgttgccaagtattgcgtcagtagcggacgtggtgatgaatacgagtaccggcgccactgggacgagtattcattatcgcggcggtaagctattacaacaatcgcccgctccgttgcggcaagggacggacattaccgtcaccgatttgttttttaatacacctgcgcgactaaaatatttgaagtccccccaaacggaattagcgaatattttagacgtggttaaccgcatcgcacttagctatccagcggtggcatttcggttagttcataatgcgaaagagctactaaaaacggctggtcgcggtgacttacaacaagtcattgctggtatttacggtgtccaaaatgcgcgcaagatggttgccattcaaggatcgaccactgattttaaattgagtggctttgtggctttacctgagctgacgcgggccagtcgccagtatattactgttctgattaatggtcgtgctatcaagaaccagcaattgaccaaagccgtcatcaaaggttacggttctaagttgatggtcggccgttatccaatcgcggtgatcgctttaacaatggatcctttattggtggacgtcaatgttcatcccacgaaacaagaagtccgtttgagtaaggaaccagaattagccaaactggtcagcaccacgattacggaccggttagtggatgtgaacttgattccgtcagcattgaccaatcttggcagccatcggcgtgaacatctaaatacagaccagctggcgatggatttgaacgccgtttcgtcacagtatcaagtagcggataagacaacgccggcatcgactgagcagtttgcagcctcgctggcagcggcaaccatgcagcccagctcggcaacgaccatggtaagtactacttcagcacagccatcagcggtaaaccgtgcagcagttagtgcggttgttccgtcagaatcagcggcaagttctgccaacccgccgattatgattagccatcgcgacgaactgacagctactccagttcaagcatttgaccagcgttaccagtcagaatcaggcgctttaccctttggtgaaactgctgaaccgttagaaaccagcacggctgcaagcgcgccgactagtgaagcgccggatacggaacgttttccacagttacgctatcttggtcagatgcacgggacttatctgttagctgaggcggatgatggtatgtacattttggatcagcatgcggcccaggagcgaatcaactatgaatattatcgccaagcgataggtgaggttagtgcggatcaacaaaatttattggttccgattattttagattacccgacgagcgatgttttaaagatcaaggaaaaattgccgttactagcagaattagggattcatctggaatcattcggcggcaacagcttcattgttcatgcccatccgacctggttcaaagctgggcaagaagaagatacgattcgtgaaatgattgattggctcttacaggatgataagttgacggtcgcccaatttcgggaaaagtcagctatcatgatgtcctgtaaacgggcaatcaaggccaatcaccatttggatgatcagcaggcccgcgcgttattagccaagttaccgacctgcgagaatccgttcaattgcccacatggccgtccggtgacggtacacttcacgaattcagacatggaacggatgttcaaacgaattcaggatagtcatgaagcacgtgattaaagtgattattggcggcgtactcgttactttagtatgattcgtaatcgatccgcattgtgcaagtaaatatttcatgaattatgattaaaacgtgccatttcttaagttcaaaagcagccagcttaagaccgctggaaaaagttcggactagcgtagacttgcttggtgtgtgcgccttacaccgacttccaggcatttctgccaattgccggaacgtggtgggcacagatttgagccgaaaaatcacgtctcaaatactggcctttcactaaccaagcacaagacgcttgctaagtgaaatttcaccactgggcattggccgaaacgccttccagtcgggacagtattcgaatggctgacatggatgcaccaacttttgatgaatttgtcgttgctttttataaacgataattttgttaatcaactgtcagactgaaaataatattgagatggctcactaatcctgaatcggtgtagtaggatttaatctcttgacagagtgcttaatgtacctagcgctttgtttaaacttccagcatcaaaatagtcagcgactaattgtaccaaattaggtggtcgttcatcagccattcgagcggtttcccgaaacgtgttcggtgccactaaagccttgtgcttgctacgccaacggactaatgccaaaaccgcattaatccgttggctaggcaatgctcggcttcaacccgtgacccctcacaggcttgagactggaggggctgggtgacaatgctcagtagccaaattattcttagctggaagtggtctgcttccggcttagaataagactcgtatttgagatgacgcgggttatgcgttagctcaaatcgacgtcggctgcgttccagcaattggcacccagccccggaggtcggcataggacgcacaccggctgacgaacaataatctaaacttggcacgttttaatcatgactgatactgaataatcacgaaccgaatgtgttatcgaataaaaatagcaatgttgagtagtccctgggttaaaaaacctagggacacttttattgtcgccagtattgcggtctaaaaaacaactttaagattggggaagtggcgtttgtgacactaatttgagttgtaaaatttcagattgaattggtttaaatagttagctatcattgattaaaatgagtggtgagcgcgtatcgggtgcttggaccactcaacatgattgggagttgattgttttggatatgaccaaactttattatcgccaggtttattcggcatattgttttttggcagatttaccagaggccacgcccgcgttcgtggccgggcgcaagacgctgtgggaattaaatgcgcatccaagtgcgcgggacgccaaattgattacgctgaatttatatgagcaagttgctgcttttgagctcgatcctaaccgtcatgatcaagcggcaatcgctacgatcaacttacaacgtgataatgctgtgagtggcttacaacctttagtacagttgtttgggagttatccggcgactactaagattgaaactttagataactgggattggcgttagttgttgatgggacagctgtgaatcacgaatttattaagattcaaactgaacatcacgagacgaaattgttcatggtaaaatagaaacattgtttgagatggcaaaatatggggattgcgttgtcgacgtaattacaagataggggcacctgatttgaagacagtacggaagataccactagtcgtctggtatacggcgatgtttgtggttattgcgacgattacttacagtgggcttttcttagccggccggacattgatttgggaagtggatggcatcgcccaacacttcccgattttattggaatttcagcggatcttacagcaccacccacaacaattattcagttggtcatggaatctcggcttgggggccgatcaactgacgactttttcctactacgtggtcggtgatccgtttaattatttagtggcgtttgtttcgcgcgctcatttggaatgggcctaccaagcgttgatcttgctgcgattgtacttcgttggacttgcttttctaggtttcagtcggcagttcaagttcaaacgtatcagtcaattgattggagctttgacgtatacgtttaccgcgtatacgttctatgttgggatgcaccacccgtttttcttgttaccaatgatttggtttccgctactgtgttgggcgattgaacgggtcttacgaggccgacattggttaccactcagtctgattaccgccgttgtaattttgagtaacttctattttgcttacttactcgcattgggcggtttagtctatgctttggtgcgtttctggtcacgtcgtcgtgaccatttaacgatgcggtcgtttggacagttattttggcggttactagtggcagttggtcttggtgtcacgatggcaggcatcttactagtgcccacgctgctcgcgatgttgacggcaacgcgtgcgagttttaactttgcgaatggcttgacgagttatcccatcaattattacgttaatttacccaatcgactgttgaccaatggtggcagtgtccaatactgggtgaccctcgggctgagtagcattagctttattgcaattatttatacactacgtcatttcagacgctattgggtgcttaattgggtactggtcgtgatgatgttgggtattttgttgcctcaatttgcggccgtattcaacgttttttcaacaccttctaatcgatggttgttgatggcaaccctcgtgtttgcttatgcgacgatggcatttatggaccaagtcactgctctgacagcggctgatttaaaatggttggctggtattagtggcggtctgcttgtcattatttggctgatcaatggattctatctcaatatccgcaaacatgatattgcgacatatctcatcttgttagcgttaattggggtcctgctggccaaacaatccttaaaattgaccaatcggcaattttatgtgttattactgggaattgtcacgctgaacctggcgaataacggactgggctggttgagtatcaatactaattctaatagtactgagcagttgcggcagggcgcggcaatgaaatgggtcaaaaattattttgatggcgcgcaaaaaagtttaaccacgactagccaattttatcgaacggctttggcacccaactactatacgatgcgttcggctgagagtgatgtgccgatggtgttaggaactcacacggttggatcgtatttttcagttcaaaatggttacgtgggggcatttagtcaggccttaggcaactcagagtatgcgatgaactcgccactcggttcgttggacggtcggacgacgatgtataacttattaggtgttaaatatttatttgcacgtgaggaccagttgaagaaacaagccttaccagccggatatgaggttgttaagatgaaaactggcgaaccgaagatttttgcggacaagtttatttatggcatgagtaatcataccggcacgatcttgttaaaatccaagaatgcgttgccgttagtttatacacagcagcatcagattagtcaacgccaatttaatcgcttgaacgcagttgaccgcgagcaagccttgttacaaggtgcggtcactacgcagcaggttagtggtgttaagactgtcaagccaaccgttaccggaaaaaacgtcgcttatacggttcaagcggatacgacgaatgttttggatacgttggacaaggtgattatttaccgcaatcaacatgcaacgggagcgtcgaacaacgcgttgactaagttaccggcagatacgatcacattaacgccggaacaacgagaaagtttgacgccggcaactggcctgacgacaccgtcaaaccgcgtgttgaacttgattgcagctaatcaaaagttagtccagaaaaatcaggaaaacaatgccgacgagttaacgagcatggtcagtgatgtgcaggggcaccagataccgtaccaattgaccattcaacaccctaagaagtatcgaaatacggaactctatcttgtgctagatggcatcagttatcggcgttcctcaatcaagcacgccttgacaacgagtcaaaataccaacgtgttcacggcccgtccgtataccaaagtcgattatctagatgatgttcgcgatggtctgaagggcaatttgagcgctagtgggtattctttaactgctcagacaacggataacttgacgagctttagtcagttgggtaccacgaatatgtcagattatgagccccggacatcagcagtaatcaacttagggtatagcaagtacgcgcgtaagctgattacgttgaactttacgagcattcgtagtttgcattttaagtccgctaaactgatcgctgtaccgcttgggaagacttatcgtcaacggacgcggcaactacagacgagtgggttgaagcatcaacaagtgacgaacaaccagattacgggaaccacgctgactaagacagcaaccgtgttaacaacgtcaattccgtattcgactggttggcagctacgagttaacggtcaaaccgttaggacccaagtcgtcaacaaagggtttgtgggggccaagttgacagccggccggcaccagattcggttgacgtatcacacaccaggactaaaaatcggcatatggtcgagtattattggtggtgtgattagcatactgattgcctgctggtgggggcttcacaaacgtgtcagacaatcttaattgagtaaatcggtattaaaataggcttcttaggaattaactttgattcctaagaagcctatttaacgttagatggaacacaaacgaatgtatgccatagcgaaattcacaattaacagccacgactggttaattatgaggtgtcgctaacgcaattaattgttcgggaatgaccggtgcagtgactaatttttgccattcactggttgagactaacatgacgagtggcgtgctgaccgttgtcaaccacgttttctgcgggataacgggtgccatggccgttgtgatgtcggtattgacctcagactcagtaatctgccagagtcgatgtgtgacgtgcgcggtatccgtcacctcgacgaccggggcaaaatgaccgacccagtcgtcaatcaacatctcgataacgggctgctgtgggtaaaggactgtgttgatcgtgccgggaaccatggtcgtcacggtttgatccaccggccagctgccaattaagcgccactggtgaacaccgttgagtgtgagttcgtaccagtaatagctggcttcggttgtcgtcattgtatcctggctgtcccaattggtcgcagctgtttgaattttagtttgaccagttgtggtcggtaacaccgctttaaacggtttgagttgcatagcgagacctccctaggactttgagcatagcatgacgttaacgtggcggcaagcatttcttgcaacgaaatccgtcaatcgaggtgaaattgatttaacattaaaatttgttttttatcggtgcaccagtgttaagccactgtgaaaatgtggtacaatttagcaagcaaacatacgttttatttaaaggagttttttcggtgtacgaatattttctcggtcaagtgaccgatgtaacccccggttatgtggtgattgaggttagcggcattggttataaagtgctaacggctaatccataccgttaccaggtgggcccaacagcagttaagatgtatatccatcaagccgtcagcgaaaatggcatgagcctatttggcttttttgatgctgacgagaaggcgttgttcgaaaagttgctcggggtttcgggaattggtccgaagtcggccctcgcgattttggccaacaacgaccatgcaggtctgatccaagccatcaatcaagagaatgcgacttatctgacgagttttcctggcgtgggcaagaagacagctcagcaaatcgtgctggacttgaaaggtaaattaaacgatctaaacgttgatgtgactggtcaaactgcgctcgatgtggatgctcctgctgttgatggcgcgttagcggacgcgttggcggctctggaagctcttggctattcgaaagcggatgtcaagaaggtcactaagaagttggagacgtttagtcagacacaaggggccgatacgaacaccttgttgagtgaaggactacgactattgatgaagaagtagatgggaggggtaactaaatggacgatgacaagttattatccggtgacaaagccgatgacgaagaggcgtcattagaaaaatcgctccgtccgcaaacgttagcccagtatattggtcaggcccgggtcaagcacgaattaggagtgtatattgaagcggcccgcaagcgtgaggaatccttggatcacgttttgctgtatggtccaccgggattagggaagaccacgctagcgatggtaatcgccaacgagatgcaggtcaatatccgcacgaccagtggccctgcaatcgaaaagccaggtgatttggttgcgctcttgaatgaactggagccgggtgatatcttatttattgacgaaattcaccggttaccgaaaatcgttgaagaaatgttgtattcggccatggaagacttttttgtcgatatcgtggtcggacaggggccaaccgcccatcccgtgcactttccactgccgccgtttacgctgattggcgcgaccacccgagctggtatgctgtcagctccgttacgtgaccgatttggaatcgtcgaacatatggcgtactatgaagttgctgatttggaagatatcgttaagcggactgcagatatttttcaaacgagtatcaaaccatcgggtgcccacgaaattgcgcgtcgctcacggggaacgccccgcattgctaatcgcttgttcaagcgaattcgtgattttgcagaagtggcggatcaagacgccattgatgaggccatcgtggcgcgatcactgacatatttacgcgtagatgatgccggcttggacgagactgacaataagctcttacgaacgatgctagagtattatgacgggggtccggtcgggcttgctacgattgcggccaatattggtgaagaaacggatacaatcgcggaagtggtcgaaccgtacttactccagattgggttcttgaagcgaacacaacgtggacgcgttgttacaattaaaggttatcagcatttgggattcccatacccagaaaataaataaagataagaggtcacaacatgagtttaacacttgaagattttgattatgatttaccacatgaactgattgcccagacaccaatcaaaaaacgggatagttcacggttgttggaattggatcgccaaacgggcgaaatgcaagataagcatttctacgatattattgatcaactcaatccaggcgatgcggtcgttatgaataattcccgcgttatgccagctcgtttgtatggtgttaaacctgaaactggtggtcacgctgaagtcctattattgcataatacggaaggtgatgaatgggagacactcatgaaacctgccaaacgtgccaaggtcggtaccgtgatctcatttggcgatggtaagttgacggcgaccgtaacggccgaaaaggaagatggcattcggatgatcgagtttcattacgatgggatcttcatggaaattttggagagcctgggtgaaacgccattgccaccatatattaaagaaaaactcgatgatccagaccgttatcagactgtttatgccaaggaaaatggctcggcagctgcgccaacagctggtttacactggacgaaggaactcttacaaaaagttcaagacaagggtattaagttggtttacttgacgctgcatgtcggactagggacgttccggccagttgaagaagataatatcgatgatcataagatgcacagtgaattttatcgattggacgaagatgctgctaagacgttgaatgaagtacggcaaaatggtgggcgcatcattgcaaccgggacaacgtcaatccggacgttagagaccattggtagtaagtttgatggtgaaatcaagccggattcgggttggacggatatctttatcaaacctggttatcaatggaaagtcgttgatgcgttcatcacgaactttcatttaccgaagtcgaccttggtcatgttagtggctgcctttacgggccgtgatatgattttgaaggcttatcaacatgcgattgatgaaaagtatcgcttcttcagttttggcgatgcgatgtttattcactagtataactggctttaaacgagatcgcttattttgaaacggatgacggttgaatattaaaatgccgtattatacgaggcgtatcgctaatttcaagctgccgttttagctctggagataataaagattgtcaatagtcgcttcaagaagttaaaatgcattcttgaggcgactatttgacgtttgaacgctttgttaacagactgactaaagccacgtgggtgcccacgccaattgccgcgactggttcacggctggatttcgtgctatcattatttgagtttagcaacattttaatacggaggaacagatatggaaccggcaattaaataccgattaattaagaaagaaaaacacacaggagcccgccttggcgaattgattacgccacacgggacctttccaacaccgatgtttatgcccgttgggacgcaagccagtgttaagtcactggcacccgaagaattagacgcgatgggtgcgggtgttatcttatcgaatacgtaccatctgtggttacggccaggcgagcaaatcgtgaaagaagctggcgggttacatcagtttatgaattggaaaaagggaatcttgacggattcaggtgggtttcaagtcttttccctggctaaaaaccgtgatattacggaagaaggggtccactttaagaatcatctgaatggctcaaagatgttcttatctcctgaaaaggccattcaaatcgaaaatgatcttggcccagatatcatgatgagtttggatgaatgcccaccattctttgaaagttacgactatgttagcaagtcagttgcccggacaagtcgctgggcagagcgggggttgaaggttcatcaacatcctgattaccaaggcttatttgggattgttcaaggtgcgggctttaaagacttgcgtgaacagagtgccaaagatcttgttagcttggactttccaggctactcgattgggggcttatcagtgggtgaatcgaaggctgagatgaatcatgttttagacttcacgacgccactattgccagaaaataaaccccgttacttgatgggagttggctctgcggatgccttgatcgacggtgcaattcgtggggtcgatatgtttgactgtgtcttaccgactcggattgcccgtaatggcacttgcatgacgtcccatgggcgtttagttgtcaaaaatgcggcctacgctcacgatttcaccccgttagatgataattgtgattgttatacctgtcgtaatttcacgcgtgcttatattcgtcatttgattaaggcggacgagacgtttggtttgcgtttgacgagttatcataacttatatttcttgttacacttaatgaagcaagttcgtcaagccattatggatgataatttactggagtttcgccagaacttctttgaaatgtacggttttaacgataaaaacccgaaaaacttttagtgctactggtatttcagaccgtaatttgttaaagttaaagatagtcaaacttttaattagagtaggagcgatattaaatgggtcaaatggcatcaattctgtttatcgtggtcatgttcgcattcttatacttcttcatgatccgtccacaacggaaacaacaacaacaacatcaacaaatgttaagcaaaatcaaacgtggtgacaaggttacgacaattggtcgcttgcacggggtcgttgatgaagttaacgaaaccgaaaaaacagttactttagactgtgatggcatctacttggtttttgatttgaacgctgttgctaagatttctccagccgaagatgcacaagctaagacagttgcaccagaatctggggcagcggctgaatcagctgctacttctgaagttgaatcggcaagctcagccgccgacgataatgctgattctgaagcaaaataggtttacaccataagtggtcgatcattactgatgaccgcttatttttttgcttattttttggtcttgaaacgcgcttttgaacgtatgttcttgtataatgaaagtactaaggattggaggggcggcggatggcacagtcaattgttgaagcgcctattcgggtggatacgagtcggaaaattattcatgtggacatggacgcgttttatgcgtcgatcgaagagcgggagcatccagcctacaagacgcagccgttagtgatcgcgcatgatcctcggcagacaggtgggcgaggcgttgtgacgacggctaactatgttgcccgccaatttggtgttcactcggcgatgccagctgctaaagcattagaactctgcccaacagcagtatttaagacgcccaactttccgttgtaccgcgaagtttcggcgcagattcatcgtattttccatgagtatacagagatgattgagccaattgcctttgatgaggcttacttggatgtgactacgaataagaaacacatccatagtgcggtcgaactggcgcaccgattacaacaagaaatttggcatcaaacacatttaacttgttcaacgggaatctcctacaacaaattcattgccaaactagcatcagattatcgaaaaccagcgggtgtgacgatcgtattaccacaggatgcagaaccatttttgttacgtgaacccatcgagaaatttcggggtgtcggtaaaaagacggtacctaaaatgcacgatttaggaatcaagactggacaggatttatacgcacagtctgaattagacctaatcaaacaatttggcaagttgggctatattttataccggcgagtgcgcggcagtgatgatcggccagtcgagtatttacgtgaacggaaatcaatcggcaaagagcggacgtttggaccgtttctccaatcgacgacggaagttaatacgcacttgaaggccatcgctaagttggtagcagctagcatgcaatcgcatcagcgccacggtaaaacactcgttctcaagttgcgttacggtgactttgtcacaattaccaagcggcgaacgttcggtgaattcatacctaatgacgcggccttgtttgagcagtacgccgaagagatttttgaagaggtggtcgatgatcattttaactctggcatccgcctgttagggatcacgctaactggcttggcaccactggcgtttgagaacttaacgttaccactttatccaaatgataattaatttatttggcgcgacgcggattcttcggtatactggagtactgtgacagtttaatcgccaccagtaaattatgagagtaagaaggttcatttatgaccgtccaaacagcaatttttgacttaattaaacaagcaaaaacaatcatcattcatcgtcatcagcgacctgacccagacgccatcggaagccagttagggttagcagctatcattaaagctagctttcctgcgaagcgggtattgacacctggaaaacagtaccatggttttgactggttaggacaaatggatgaggttaccgaagcggactatcaagacgcactagtattaattcttgataccgctaatcagccccgaattgatggtgaactttggaatcaaggtaagacaattgttaaaatcgatcatcacccaaacgatgacgctttcggtgacccacagtgggtcgacgttgatgcttccagtacgagtgagatgatttataattggtacgcaccccttgcggcggagttaacgctaacggctaacgccgctcggttgttgtatgccggcatcgttggggacaccggtcgctttctatactctgcgaccaagcctagtaccatgcgagcagcagcggccttaatggaagccggtgcggatgctgaagctgttaatcgtattgaagataccatcacgttaccagtcgcacggttgtcggcctacgtttatgaacatctgacacagttggattcgggtgcagcttacgttattttaacgaatgcgattctcgattcatttgcaatcggtgatgctagtactgctggggttgtcccattacctgggcgtattgatacggttaagtgctgggcgatttttgttcaacaaaaggaaggtgacttccgtattcggttacgttcaaagggaccgtcaatcaacggtgtggccaagaaccatgatggtgggggccacgcattagcgagcggtgccaaggctaaagaccaacaagaaattgaaacggtagtgcgagaactcgaccaagtcgctagccattatgagaaagaggtttaaatatgaccgcaagttttgaagattttaaattgcagccgttcttgatgcaggcactgactgacatcaatttccgcaaaccgactgcggtacaggaaaagttgattccagtgattgctgctggccgcagcgtcatcggtcagtcagcaactgggagtggtaagacgcatacgtttttactgccaatgatcaatcaactgaatgctgatgaacgttacgtgcaggcagttatcacaacgcccagccgtgaattagcttatcagattcagactgctgctaaacagttgatccaacacagcccgaaagccattcacattggactctatgtcggtgggactgataagcaggaacagattgaaaagctaaatcggcaccaaccacagttgattattgggaccccaggacggattctggacttaatgcgctcccaggcactcgatgtgcatcgtgcgactcagctagtagttgatgaagccgatatgacgctagacttgggctttttgaacgtggttgaccagattgctggccgaatgcctgctgatttacaaatgttggtgttctcagccacgatgccacaaaaattaacgccatttttgcgcaagtacatgaacaatccagttatggaagaaattccagtagaatctgtgattagtccgactattgataactggctgatttccaccaagagtcacgataaaaacagtattatttatcgcttgctgacgattggtgaaccgtatctcgtgttgatttttgctaacacgaaggaacgagttcaagagttgacccattatttgcgccaacaaggtttaacggtcgcaatgatccatggagatattcaaccacgtgaacgaaagcgggttatgcgcgacgtccaacaattgaagtatcaatttgttgttgccactgatctagctgcccgtgggattgatattgaaggtgtttcacacgtcatcaatgatgatattccgaatgacttagaattcttcattcaccgtgttggccggaccggccggaatggaatggcggggactgcgattacgttatatagcccaggcgaagaagccaaggtcagtgcagttgaagcaatggggatcaagttcaaaccgaaggcgattcgtgatggtgagattgtggattcatatgaccgtaatcgtcgggctaaacgggggccaaaacaggaaaaactggacccaaccttgattggttacgtcaaaaagtccaagaaaaagatcaagccgggttacaaacgccgcattcgtaaaaagatcagcgataaggcgcggatggaccgccgcatcgaacaacgagcggctgcccgcaaggaacgcaaggatcgtaagtcttaattgacgtgcatccggatagattaatgcaaaataactgagtggtgtattgacaagtcgccgcaagttttctatactttgcaaagtaaggacatatctatctcacatatcggtcaagaaacactttggttgctggaaaaagtgcggtgtggggtagatgctacctagaagtaatgactagcaaactagtccgtgtctcagcgttaatgagcttaagaggtaaacgaacacatcgttgcaagcagagtggtaccgcgttaacagcgtctttgctagcaacggtgtttttttgccttaaattaagaatgatagagaggatgccagaattaaatgaaaaaattaagtagtagtgaaattcggcaaatgtacttggacttttttcatgaaaaaggtcatacgattgtccctagtgcatcactagttcccgtggatgacccaacgttattatggatcaactccggtgttgcaacgatgaagaagtactttgatggctccgttgtgccggataacccccgcatgacgagttcacagaagagtattcggacgaatgatattgagaatgttgggcggacggcgcggcaccacacgttgtttgaaatgcttggtaatttctcagttggtgactacttcaaaaaagaagcaatcagttgggcctgggaactcttgacctcaccaaaatggtttggctgggatcctgacaagttatacatgactgtttatcccaaggacacggatgccgcgaaattctgggaagcaactggcgtgaaaccagaccacatcattaaagtcgaagataacttctgggacattggtcaaggcccatctggccccgattcagaaattttttatgatcgtggcgaagctttcaataatttagctgatgatgacccggaaaactatcctggtggtgaaaatgaacgttacttggaagtttggaacattgtcttttcgcaatttaaccacactcctgaaggtacttacgaaccactcccgcgtaagaatattgatacggggatggggctagaacgggtcgtttcggtctttcaaaatgcgaaaaccaattttgaaactgacctattcctcccaattattcataagacggaagaattaagtgatggcaagcactacggtgataacgcccaggacgatgtgtccttcaaagtgattgccgatcacgctcgggccattacgtttgctattagtgacggggccttaccttccaacgaaggtcgtggctatgtcattcggcggttgattcggcgggcaatcctacatggtcaaaaattaggtttgaaagaagctttcttggaccaattagtaccgattgttggcaagatcatggcttcacactatcccgacgtgctcaaaaatagtgcgtatatcgaaaagatcgtggcttcagaagaaagtcgcttcaatgagaccttgaatgatgggttgaatctgttaaataacttgatcgcggaaaccaagcaggctggtcacgatacactagctggtaaggatgcatttaagttatatgacacttatggcttcccgttcgaactaactaaggaatacgctggcgacgaagatttagatgtcgacgaagctggttttgaagttgaaatgaaggctcaacgtgaccgcgcacgcaatgcacgtagcagtgccaagtccatgggcgtccaacggagtctcttgatcgacatcaaaacgccaagtgaatacgtgggatatgacgaattaacgaatgtgcaggggactttgaacgacattattgttgacgagaccctggttgatcacgtcgacagtggtcaagctgagatgattttcagcaagacaccgttttatgctgaaatgggtggtcaggttgccgaccgtggtgtgatcttagatgatgccggtgaaatggtggctaaagtgactgacgtacaaaatgcacccaacaagcagcatttacacaccgttgaagtgttgaaaccaatgcgaaaagacgcgacttatacgctgaacgttgacttggcattccacaacaaagtcgaaaagaatcataccgccacccacttgttagaccaggcgcttcgtgacgttctcggtgaacatacgaaacaagctggttcacttgtagaacctgattatttacggtttgactttactcactttggtcaagtgactgacgaagagttagctaaagttgaacaaatcgtcaatgataagatctgggcagcgttaccagtcagtgctattcaaacggaccaagaaactggtcacaagatgggcgcaattgcggttttcactgaaaagtatggcaaaattgtgcgggttgtttcaattggtgattattctatcgaattcgatggtgggacccacgttaagaacagtagtgaattggggctatttaagattgtttccgaaacagggattggcgctggaacgcggcggattgaagccgttacttcgaaggaagctttcgaactgcttgccggcgaagaacaaaccttgaagcaagttgctgctcaagtcaaggcaccgaagttagctgatacgccagccaaggttagtcagttacaagccgatctcaaagcggaacaacagaaccgggccagcctcgaaagtcgcttagccaaacagcaggctggggcagtctttgatcaagttgacgatgtgaacggtacgacgttgatcgcccaacaaattgaagtctctggcatggatcaactccgtcaattggccgatacttggaagaccaagcagtattctgacgtactggtacttggaacagtcattggcgaaaaggtcaacttattagttgctgttagtgatgacaaggtcaaggcaggtatcaaagctggtgacttgatcaaagccattgcaccaaaagttggtggtggcggcggtggccgcccaaccttagcccaagctggcgggaagaagcctgctggactaccagcggcgctgaaagctgcgcatgagtggcttgccgaacaataagactgattgctttggttgcacatcctgttttttatgttggttagctatgttaaagctatcaaaataacaattaaatcagtgctgttaggacgagaccgttctaacggtactgattttttaatgttatggcaccttgtgaccggcttaactcgtagaagattgggttacaaagggtgtgcctgttttgaatttcaactattcgaacattcgaaacaggggtatgtcagcatatgaaaaaaacagtgtaaatcgggatggatttgcagaaaacgtctgcattctccgggttattattacgaatgtgttacatcaaagtggattgattgtacttcatatgggcatttagtaaaatagattagaagcggaaactagcgggaggtgcttgatatgagttcattagacaaaacaatgtactttgacttcgataatgacagcgttaaggatgtccacgacacgttaacgacagtttatgaagcgttacaagaaaagggctacaatccgattaatcaaatcgtgggttacttactatccggtgatccggcgtatatcccgcgcttaaaggatgctcggaacttaattcggaagcatcagcgcgatgagattatcgaggaacttgtcaagtcttacttaaaggcagataaggatgttgatgcatgaagttgatggggttagatgtaggttccagaactgttggcgttgccattagtgatgcttttggatggacggcgcagggcgttgaaattattcgaatcaatgaggatgctgaggaattcggaatcgaccgggttgctgaactcgttgaagaattggatgctgggggctttgtcctagggctaccaaagaatatgaataataccttgggaccacgggctgaggcggcgcaacattacggcgagttactgacagcccggtttcatttgccggtagactttgaagatgaacgtctgacgaccgttgaagctgaacggatgttggttgaagaagctaacacctcacgtaagaaacgcaaaaaggtgatcgacaagctagctgcaagtttaatcttgcaaaactacttggatcgccacggcaaactcacacaagaatagcgaggaactaacatgagccaaaaccaagatcgtaaagacaatgatgtgatcacattagttgatgacgaaggtaacgaaaccttatttaatattttgttcacgtttgattcagaagatttcggtcactcctatattttattatatccagctgatgctgcggccgatgatgaagttgatattcaagcctacatctttaatcctgaagatggcgacaatggcgaattacaactgatcgagtcggacgacgaatgggatatggttgagcaagttttgaataccttcttagccgatgacggtggcatgcaatagtcgaaagtagattaagctcgtgggcgcatgtccgcgggcttttttagaaattatgagacggttctaactgtcgcataattgtgataaccatgctagaatattaattgttattgaaaggaagcgggatgttgatgactgctaacaagcgccgctttaaagcggaaattgatggtcgtacttacacgatcattggcacggcatctgaccgtcacatgcaaacggtgacgcggatgatgaatgagcaagtggcacaattaaaaaaattagcccccgatttgtctgatacggagattgcgacgttgctcgcattcaatgcgatttcagatcaggttgacaaacaagctgaattattgaaaatgcaaacggatgatgccgacaagtaattgcattgtccgtttttttgcggcttttcgtaattcattggaacttcggagggatatcagtgaattccaaagtattgaatacgttagagtaccaacaagtaaaacaacaattagcaccatacttagtctcggtaacgggccaacaagcactcaatgaactacacccaatgaccagcgttgcggatattcaacgggccttagatgaaaccaacgatggggcagaagtgtatcgtttaaagggtggcattccggtcgctcgtttagcggatataaaaccgcatatgaaacggttagctatcggtgcgaccctgaatgggagtgaactcgggcaagttgggcgggtgttacggacaacgcgcgcaatcacgcgcttttttgccgagttgctagaagatgcccctgagaatgatattcgacacctgtttgatgaagttgcagaattagttactttaccagatgtgacgaagcgcctcgctactgccattgaaggtgacggtcatatcacggatgaggcgtcaccagaactgagccggattcggagcaatatccgtcgtactgaaacggagattcgtaaccaaatgggtcattatacccgtggccatgatgccaagtatttaagcgacccaatcatcacgattagaaacgaccgttacgttatcccggtcaaggccgagaatcgcagtcggtttggtggcatcgtgcatgatcaatcagcgagtgggcagacgctctttatcgaaccccaggctgtcatggcgatgaatgaccggttacggcaaaatcaagttgcggaaaagcaagaagaacagcgtatcttggaggaactctccaacttgattgcgccttaccaggacgaaatcattaataatgcggcgattcttggacatttcgactttatcaatgccaaggcgcgttatgcgcatgatatgaaggcgactgaaccggccgtttcacccaaaaatgaagtctatctacggcaagcacgccaccccctgattgatcctcgcaaagtcgttgccaatgatattagtttaggtactgattatcaggcgatggtcattacggggcctaacactggtgggaagacgattacgttgaagacgctgggattactacaattgatggcccagtcaggattatttattcctgttgaagccggaagtcgcgttggcgtttataatgagatctttgcggatattggtgatgaacagtcgatcgaacagaatttaagtacgttctcatcccatatggaaaatattgaaagtttcttagcgcagatcgacgctcacagtttagtactcgttgatgaattgggtgccgggactgatccgcaagaaggtgcggcactggcaatcgcaattctggatgccattggggccaagggaacccaagtcgttgcgacgactcactacccagaacttaaggcgtatgggtttaaccgacctgatacgatcaatgctagtatggagtttgacgaagaaacactcaagccgacgtaccggctattggtcgggattcctggtcgaagtaatgcgctcgatatcgcacagcggttgggcatcccgcaagcgattgttgatcaagctcggtcgttgacggatacggatagtcaagacctcaacgcaatgattgcggatttggtgacgaagcgcaaacaggttgaagatgaacaactgcatctgaaaacccaagtggcagattctgaaaaattgcaccggcagttgaaaagcgaattcaatgcgtatcaacagcgtaaagatcagttgatcgaagatgccaaagtgcaggcgaacaccattgttgagcaaagtaagactaaggccgatgctatcattagtgatttgcgtaagaaacaattagcgagtggtacggcgactgtcaaagaaaacgagttgattgatgcgaagggcgcgttgaatgcattggagcaacagcctaagctcaagaaaaaccgtgtattacggcgtgccaaagcccaacatgattttcatgaaggtgatgacgtgctggtcaaatcgtatggtcaacgtggtgtgttgatgcgtcagatgggtaaacacgagtgggaagtccaactcggcatcttgaagatgaagattagtgacggtgacttggaacgcgttaagccagaagagccaaaacgcgcgcgtgctactgttcagagtgcccacgcgagtcacgtttcgccgaacttggacctgcggggtgtgcgttatgaagacgcgatgactcaagttgatcgctatattgatgctgcgttgttggccgggtatccttccgtcacaatcgtacacgggaagggaactggtgctctacgagaaggcattaccaactatctcaagtctaatcggcaagtcaagtcgtttcactttgctgcgccaaatcatggcggcaatggtgcgactgaggtgcagttcaaataaccagtgacgagtgccaggtgcagatcagtgatgacgcgaattcatggctgtgcacgatatcggcgctttgattgcaggcaaattgtttgtgttccacccggttactggtatacttactattagtaacagataaagcttaaaggaggccgattataatggtcgcagcaactactgataaaacttttacaacggatacggcttcaggagtaacgttaactgacttctgggcgacatggtgtggtccttgccggatgcagtcaccagtggtcgaacaattagctgacgagatgggtgacaaggtgacgttcaataagatggatgtcgacgccaaccctgaaacggccagcaactttggtatcatgagcattccaaccttattagttaagaaggatggcgaagtggttgataccttagttggctaccattccaaggaacagatccaacaaactttagctcaatatctataataagctgggccattatttcattaatggttcgctagcgaacgcgccttcttaagtgaacggcgcgtttttttgcgctcttttttaagaccggggacaaccgttaataatgactatataaggaaaactatttaacgttgcaaaaaagggcgaccacgtggccgtcctttttactgtgcttcttcaggttgttcgtcatcaagttcaacttgaggccgcacgatttcgattggtgttgcgggatcgtgattgacgattggttgattgtgatcaatcgtaactgagatgcgcagtcgcatgcgattttggaacgtaattttagcttcactcacacagttggtgcggagcgccgactgctcagctagaaagccagtttcaagcataaagtctggtgatttgatcgtggcgctacgccgagcgaccggctcaccagtcaattcatacgtgattagatcatccgtcgttgtaatcacgacaaggtgaccccagccggtttgctcaaaaaaggtaacaagatcatcatcactagcgacaggaaactggcgtgccaagtctttacccgcccagtaaaggatgccactactgtcatcacccaataactttggtattaaggcatctcgcaagatttccacactgaggatggaagctttgatcgagttgcccgcaaattgagaataaaagtcgttcgtcatgataattcctttccatgcaaaaaatcgtggtactctagccactgtataatcattattataccccgtttccactaatgtgtcggtttttttcaatttatcaacggaaactttacaatttcgtcgcaattggtctggcttgaaatcaatttcaaaaaagaccataataaagtttcagaattcagtgaacggagattttaaaatggcaaatgaacatgcaattggcttcatggattcgggggttggcgggttgactgtcgtcaagcaagctttgaaacaactcccgcgcgaaacagtttattttattggtgatcaggcacgtttgccatacggtccgcgaccagctgaacaagtgcgaactttttcttttcagatggcggatttcttaatagcaaagcagatcaaaatgctcgtgatagcttgtaatactgcgaccgcagcggcattgccggcgttgcggcagcagttgtcaattcccgttattggggtgattgcgcctggttcgcgggctgcgttaaaagcttctcatcgtaatcgaatcggtgtgattgcgactgaggggacgattcgtagtaatgcttatcgagatgctatcttaaccaaagatcctactgcgacggtcgtttcgcaggcgtgcccaaagtttgtgccgttggttgaatcgaatgagtatcaatcaacggttgccaagcgggtggttgcggaaacgttgaaacaactaaaaaaacaagacgttgatacgcttgttttgggctgcacacactatccattattgcggccacttattcaaaatgtgatggggcctggggtgaccttgattgattctggtgccgaaacggtgaacgatgtctcggcggtactcgattacttggatattgctaacgatcgttctactaagcgttatccggatgagtactacacgacgggggcggctgatcaattcgaagcaatcgcgcggaactggttgggccaaccggactttcacgcacaacatattgatttagggagtgaagcgaatgactaaaccacaaacattgatcattgcgactaacaatgccaataaggcgcgcgagtttagcgcgatgttggcaccgtatgatattaccatcaaaacgttggctgattttccaaatattcctgaaattaaggagaacggtatcacgtttgaagaaaatgccactaaaaaggcgacggttgtggtcgaagcaaccggattaccggcaattgcggatgattccggcttgatggtcaaggcgttgcacggtgatccgggagtgttctcggcacggtatgctggtgatcatgatgatgctgcgaataatgccaagttgttagccaaccttggtggcgttcctgaagcggagcggaccgcgacttttcatacgaccctggttgcccttaaacccagtggtgagaaacttgtcgttaacggtgagttagccggccgtattctgattgccccccgtggtgacaatgggtttggttatgatccgttattttggtcaagtaagtttcaaaaatccttggcggaattgacgccagcacaaaaaaatcaaatcagtcatcggggtgcagccttgcgacaactgatgactaaattcgatgaatggtgggcgaaagcatgaaatgtttagtagtgagtgatagccatggcgatcgtgacgtgttagttcgattgcttgataagtaccgcggtcaggtcgacgccttttttcactgtggtgattctgaattaccgcatgatgacgcggtttttcaagagatgttcacggttcaaggaaatatggatttcgatgccgtgattccaaatgaagtgaatccaactattgatgaggtgacagtctacatgacgcacggtcacttagtcggtgtgaacatgggattggaccatctattagctaatgctgaggtgcacaatgcgaagctggctttctttggtcacacgcatcaactgggtgttgaacgacgaggcggcgtggtcgtgcttaatcctggtagtattacttatccgcgtggtgaatttgcacgtatcggtggcacctacgccatcgtgacaacgtcagccgcaggtatcgacgtccaatattatgatcggcaactacaagcggtgccagaactaaaatttcattttgctgattaaaatgtggtaaaaaaactgatttttagggctgtgcaaagtgcttttgcggttaaaataaagggatgggcttagtgaaggaggcgctgtatgttaattcaaccagttgaggacttattgtcacgtaacgccgaccattatttgattccggcggacgtggttgccaacgttcaaactgataataatttgtatcacgcgtttttagtactaacgaaggtcaagtattccaaaattccagtacttgatcatggtggtcactttgaaggtttagtatcgttgccactgattactgaacaaatgttaggttttgatcaactgaatactgaaatattactgcaaaaacgtgtctgtgacgtaatggagacacaagttaagacggttcatgatgtggatgacgttgaagagacgttacacttgatgattgataatccgtttgttccagtcgttgatgaacagcaaatttttcaaggaattgtcactcgtcgtgaattcatgaagagttttaactttctgacccatgaaatcggcaaacaatatgatatgattgagaaggatttttccactagtgaaaaagctaaataaatttttggagggtctccgatggcaaaattagatgcacaatcaattattaactacattggcagtgcgaaaaagaaaacacccgtaaaagtatacgtgaagggtgctttagaccaattaaacgttccagcaggcatcaaaactttcttcagtggcaacgctggggtattattcggtgactgggcggatgttgaaccgttcttaaaggctaacgctgcaaatatcgaagattatgaattagaaaatgacgcgcgcaattcagccgtaccaatggcagatttgaagcaatacaatgcgcggatcgaacccggtgcgattattcgtgaccaagtattgattggtgataatgccgttatcatgatgggtgcggtgatcaacattggtgccgaaatcggtgaaggctcgatgattgacatgggtgccattcttggtggtcgcgcaattgttggtaagaactgtcatattggcgctggtactgtgttagctggcgtggtagagccaccttcggctaaaccagttcaaatcgatgacgacgtgctgatcggtgccaatgcggccgtacttgaaggcgtgcatgttggtaagggtgccgttgtggctgcgggtgcgatcgtcattgaagacgtcgctcctaacaccgtagtcggtggggttcctgctcgtaagttgaaagatattgatgataagactaagagcaagactgaattaatggcagaattacggaatctttaatggtggagggataaacaatggtcttacgggaaaccgatctaattccaatttatcaacacttacaccaaattccggaaatcggcttacaagaacatgaaacacaggcttatttattgtcgattattggtaagatgcctcaagagtggctgacaatcaaaaccattcctactttggatacggcgattttagtgaaagtcagtggtttaaagcatgattatcgaatcggttatcgaactgacatcgatgcgttaccagttactgaaaatacgggcttaccatttgcatcgacccatccaggtgtcatgcacgcgtgtggccatgatattcatatgtcagtcgcgctaggaatcctaagctactttgcagagaaccgacctgcgaccgacatggttttcatgttccagccggctgaggaaaatgcctcgggtgggcaacgcttgtacgaaagtggtgcgctagatggtgattggatgccagatgagatttttgcattccatgacaatcctaatttaccaactggagcgatcggttgccggatgggcacgttatttgcgggaacttgtgagatccacgcacacttaagtggtaaaagtggacacgcggcttacccacatcaagcaaacgacatggtcgtcgctggtgcggcgttagtctcccagctgcagacgattgtagcgcgcaacgtggacccgattcaaagtggtgtggtgacattaggtcactttactgctggcacgattggcaatgtgattgccggtgaggcccagattgacgggacgatccgagcgttgacgcaggagatgaacatgcatattcagcggcgggttcggacgattactgaggggattgcgctcgcctatgactgcaatatcgatttgaagctcaatcaaggtggttattatcccgttgagaacaatgacgcaatcactgctgattttatcaagtacatgcaggatgatgatgatgtcaactttattgaaacggaaccagcaatgactggggaagactttggttatttgattcatcagattccagggacaatgttctggttaggggtcgacagtccatattcgttgcactcggaaaacatggtgccgcacacggctgccattatgagtggggtcaatgcgatgaccggctttttgactcatcggaatgcgttacacaaataaattacaaaacgtactgcgctaacacgtgtcagtacgtttttgagtttcaagaatgccgagcgttgttgaaattaatggttggttgtgaccgcacaatagttttcgcctggtcatgttaggttgcgaatgggaataactaaaactattcctgacaataacaacgtgcgtcatggttcccacctgaagaaatttgtcagatgaaagatcaagcccgcaccgtggcgctcatttctgagcaaccgctgtgcgggcttgtgttggttgagcttacttgtgcgttggggcgatatttaaacgtggcgaggggagttgaattcccgctgctcgggccgcgttcaagtaggcggccaaaaagtcgcgctgaattgcgaactgcatgccatttttgacgtaaaattgtactcggaagaccaacgtcccatcggcttgtgtcgtgacgccttgaatgtcgggctcaccgatgatatcaggatactgaggtacgaggtcggcattagtttcgcggaccacgttagtcagatcttgaacgggagtcgttgtgagaatgtagaggtcaatcagcacgcgcatatcgttacgcgactggttgctaatgattaaaatcttgcgattgggaataaagttcaacgtgccatcgggactcgtaacttgagttgtccgtaaaccgattgcggagacggtcccctcaatggtttcgattttgacgtaatccccaacatcaatctgatcttcaagtagaatgaagaacccggtgacaatgtcactgacgaagccttgggcgcctaaacctaacgccacactgaaaatcccagcactagcaatcaacgtccccacgggaacacctaacactgaaagtaccgcatagatgccaaaaaacatgatgacgtaatggtagatatttaatgataatgtaaaaatcgttgaaatccgattattggcagtatcactggtattagcattcgttaaaaataagtggtggatcaggcgttttcctagccgatcaatcacccaaaatagtaaaataaataaaatgatttcgagtagcttgccgccaatattaataataatttgttgccagtcaattttcttagccaacttcatccacaccgaaacttgtttagtcggtgtgtcaaccgctgctaggttaattgaattaaacatatcttcaccctcgttattgttgtctgttcactagtttatcagatttgacgcgggcaaccaagccgtgatcaagttattgcgaccaaatgtgactgggtgaatgttgtaagcacttttttaattgcggtatactaaagacaatgctatgctagttttaatatcatggctgttgaaggaggaattttaggatgattacacacattgcgggcatcattgccgccattgcgttcttattattagtatgctttatcgggatttttttaatgcggattactaaaacgatgggggaagtcaaccgtagtttaaataatattacggatgatgttgacgccttgtcacatgagactgaaaaaatcatggcaaatgccaatgaactcttaaaggatgttaacggcaaagttgcaacaattgatccagcgtttcaagcgatgggcgacttaggtcagagcgtctctgacttaaatgctgcgactcgagacttaacagccaagattggcaagaacaatgagaagcggagcaagttctccagcgcaagcaaggtcggcaaagccgcttttgatgtctatcgtaatcgacgttcaaaaaataatagtgaggagtcttaattatgtcgaaaaagggattcttattaggtgttgttttaggtggtgcagcgattgctaccgccgttatgaagatggatgatgataaaaaggctgaattgaaagctaaagcacagcaaggaattgccgattttaaggatcgggcaatcgactatgcgttctatgccaacgatgctgctgaagacttcaaggctgaagctgggcaacaatttgaagatacaaagcgaaaagtggccgattttgctgaccagtatcaagccgctaagcaggaaacgggtgaaagctttggctcaagtcttgaccaagctacggatagtttacggtctgaattagctaaggtcgaagatgatgaaggtgatgatgaagatatcgtcattgatggtggagctgcttatcaaaaagctggcgaggacgagaagacttcagcgcccgtaccagaatcagcacctgctaaggacgcaacacctgcgaagtctgatgatgaatcgacaacggatgaatcgtcaccagccaagtaagctgacagcgataagataggacactgagcaagtgctcggtgtcctatctgcttttgaggaggaatcacattgtattcaatcggagcggtcgccaaaaagaccggtatttcaagttatacactgcgctattatgataaggcgggcttaacgccctttgtgaagcgtgataagcagggccgccgggtcttcaatgatgaagacttggattcactggcattgattcgttgtcttaagcagaccgggatgccgttagaggatattcgacaatttattagttggtgtgccgatggggatggaacgattgatcaacggctagcaatgtttgaagagcaacgccaggctgttgaagcgcaaatccatcaatccttgttgaatttgcaaaaagtcaatcataagattgatatttatcggcgtgcgagtcaggcggggagtgaagccgcggttgactgtgacgtgctgccattgaaaacgacggcggcactgttagccgaagtggctgattatgaaaccgaacatccgctaccggaataacactaaaagcaagtaccagtcaacgctaggtaaaaaaagagggccgtcacggattatgtcgtgacggccctcttgacgtttttaattaaagatctaatactttaaattcttttggcatatgggtaaatggcttaaagccttccttagtaacgaccccacagtcttcgattcgaacaccagctacgccgggaatgtagatcccaggttctactgagaagcacatgccttcaacgagtggcatgtggttaccagccataatcgaaggaaattcgtggtcagtttggccgattccgtgacctaaccggtgaatgaagtattcgccatagcccgctttggtgatgatatcgcgtgcgattttatcgacatcttcggctgccatgcctggtttaatggccgcttgagcagtcaagttggcttccagacagacgtcaaagatttccttttgcttggcactcggttggccataagcaattgtccgggaagcatcagaagcatagccttcatacatgacgccgaggtcgaatagcactaattcatttggcttgacttgggtttcgttagttgcaccatgggggttggcggcatgttcaccagcttggactaaagtgtcgaaactcatttccataattccctttttcattaaggcatactgtaattcggcagcaatctgttgttcggtgcgacccgccttgacagcagcaaatccttgttcaaaagcaaagtcggcccatttaccggcaatgtttagtttttcaagttcatcagctgttttgaccagccgtaattgctgaatataaggtgatagatccttatcgaagtgggcagctggaaattgctgtttgagcgcggtaaagcggtctaacgtcaagttcccagtttcaagggcccaaactttaggatcagtcaattgtgcgtgaatgtgatcagcaattagcgcgtatggatcttcatggtcgaggtagccgaaaactttgtaaggccagcccatctccttgattgcttcaacttcgagagcgggtgcaaagagaaatggttccgcatccgcgaaaacaaacagtgctagcgtccgttcgtaggggttgctctcaaaaccagtcaaatatgaaattgtgtgaaagttactgatgtaggtcacgtcaacgtgattgtcttgggtccattgacggacttgttgcagtttcgtataatctgtcaattcaaacactccttagataaaataatagataataatactagtatagcgctgttgatgataaaaagctgagaataatgagcccaaaataacaatcttcgtgtggtaaatcttgcattttgaaaacaagtacggtattattttcatgaaagcgatttcaataacaatcttaagttgcattggaagcgtaattttgctatattggttgatgttgcatgaaaacggatgaaaacatatgataccaagcaagaaagggctatttttatatggaaaaacaaacagtaacaatttatgatgtggcacgcgaagcggcggtttcaatggccacagtttcacgagtcgtcaatggtaatcccaacgttaaacccgcaacgcgtaaaaaggtactagctgtcattgaacggttagattaccggcctaacgcagttgcacgagggttagcaagtaagcgttcaactacggtcggggtaatcatcccggacgtgaccaacatttattttgcggcgttagcacgcgggattgatgatattgcgatgatgtacaagtacaatatcattttaacgaactccgatgatgcgggtgaacaagaagtcaacgtgttgaatacgttgatggctaagcaagttgacggggtcatctttatgggtaaccatattgatgacaagctccgggctgaattcaaacgggccaaggcaccagttgttttagctgggacggttgatccgaacaatgaaacgccaagcgttaatatcgactacgctgcagctgttgaagaagtggtcactaacttaattgcacgtggtcacaagaagatcgcgttggctttaggctcattgtcacaatcaatcaacgctgaataccgactgacgggttacaaacgggccttaaccaaggctaagattccgtttgacgacgccctcgtttatgaagcgggctactcatatgatgctgggcggaagttacaaccagtcattgcggatagtggcgctactgcggtattcgttggggacgacgaaatggcggctggtcttatcaacgcaagtatggaatccgggatcaacgttccagatgacttggaagttgtgacgagtaatgatacgattattacccaaatcacgcgtccagccattacctcgattacccaaccattatatgatattggtgcggttgccatgcggatgttaactaagttgatgaacgataaagaacttgacgagaagacggtcaccttgccatacggcattgttcggcggggctcaaccaagtctgctgattaagttcggttgtctgccagctagtgacgttggcataatttagaacgatagcgttatactaggtttggaatatttattccaagcctttttgggttttggaatgcgtgaaaggatgagttaaacggatgacacaactaataatgcggccacggcccggaaaaattaagttaggcttgaaggcgtcccaagcacccgcacaattaatggatcgtttgcaataccggcccgaagtatttgaattttttacgagtgccacggactttgaaccggaagcatttcagacacttaaaacagctgtccaatttgtaaagacaactgtcaccgagcaaattgtgattcatcaccctatgagttatcaaggcgttcatcttgatcaattgcttgatccacatcgtgaagctgcggcgtaccaattcctacaaacgagtacggcccagttacttgcgttggcgacggaattggatgtcaaggtgctcgtacacggtggctatggtagcgacagtgggcgcttgatcgatgagtatgagtccttgcaggttgcacgtgacgtggtctttgagcggttggataatttggttcgtcaggcgagtggacatgtcgtgattgaaaatggggtaacggcaagttttatgtatggtaatccccagttagatgagcgtatcattcagcatcattatccgctggtttgtgatttgagccacgtcttcattgcgctgcacggtgatatggaattgaccatgttggctttgaagcggctggctccactcattcaacattatcatttggttgattcgatggggacgcggcacgatagtttacctttagggcagggactgattgactggcagcgggtgttaccagtcctcaacccgcacgctaccatgatttatgaagtgccggatgaaacggatgcgacctgcgctaacatgttgagtagctatcactatctacgcgcactcgaactgcggtcgatcgagggaggacaagcgaatgactaacttagtagtccatgtcgacgagccggctaaggtcgcaacggccataagcaatgtgcagaattttttggcagcccggccaactagtacggtggtggttgtggtcaacgggcccgctatcacgacgctggcaactggtgcctgggagccattacaacagacgttaccgcaagttgagattgatgcttgccataatgccatggtgagtcatcaaatgactgcggcccaacttcctgccagtgtgacggtcgttctcgctggtgtggtgcgaatcgtggacttgcaagctgtgggttacgcatatttacggccataacaccagtttatcgtggttgtggttgtcattagcaaactgaaatttcaaatctgaaagagagtccaataacgaaactggttcattagatttgcaataaaaatcgcagaacttggacgcccttggttctagtgcttgaaatcgctcgctttttttgctatcatactttacgtatgtttatctactaaactgaaaataaatatgaaagaaggagtcacacatgtcaggacattcaaaatggcataacattcaaggacgtaagaacgcccaagatgctaaacgtgggaaagtctttcaaaagatttcccgtgaactttatatggctgtaaaagccgggggtcctgatccagattctaacgcgcaattgcggttagttatggataaggccaaagctgccaacatgcctaaagacaatattaaacgggcggttgataaaggtagtggctccggtgcggagaactacgaagaagttacttacgaaggctacggccctggtggtatcgccgttctggttcacgcattaactgataacaaaaaccggactgctgcggcggttcgttcagcgttcacgcatcatggtggggccttagccgcaactggtgcggttagttacatgtttgatcgtaagggttacatcgtgatcagtcgcgaagatttagataccgacgaagatacgatgttgatggacgttttagatgctggtggcgacgatttacaatcaagcgacgaagcgtttgaaatttacactgatcctaaacaattagctgccgttcgtgatgccctcgaagctaatggttacaagttggaaacagctgaattaaccatgattcctgaaaacttaacggacgttcctgctgataaagtggaaaagttacaacacatgattgatgaattggaagataacgacgacgtatcagaagtatacgaagctgctaactacccagattaatgatgaaatgacgtggttctttgatgataaatcaagaaccacgttttttattgcttaaaatattagtaaaacaagtgcgtcgaacaggccagtttgctaaaattagagcagttgaatactgaagggacgaataatcatgaataaagtaaccgtactaggtagtttgaatgttgattcgattttgcgtttcaagcgttttcctaagcctggtgaaacgctaccactgactggtaagagtgtcgctggtgggggtaaaggggctaaccaagccatcgcagccgcgcgcgctggtgcccaaacgacttttatcggtaaagttggtactgatcaggaaggggcctttatggtgcagcagttgacgaatagtggtgttaatgaccaatatgttcaacatagcaatgtggctagtaccggctcagctttcatcttgttagatagtagtagtgagaaccgtatcttaatcgatggtggaactaatcagcaggttacggccgaagatgtcgaacgggcccaacccgcaattagcgctagtacttttttgattgcacagtttgaaacgcctattgcagcaacgattcgagggtttgaattggctcaggccgctgggcaaaaaacgattttaaacccggcaccagctacgacgacggtgcccgcagaattactagcgacgaccgacttaattgttcctaacgaaactgagacggaaaccttgactggcgtgcacattactgatgagcaatcgatgattcagggcgcacagaagttgcaggcgctgggcgttgctaacgtgatcattaccgttgggagtaaaggcgctttctggatgcgcggtgctgagcacggcttcgtcccagcttataaggttgaggccgttgacacgactgcagctggggacacctttattggtgcactcagttcggtcttaatgccagactttagtaatttggccgctgcggtacggtttgccaaccgggcatcttcgatagctgttcaaaaattgggtgcgcaaccatcgattccaactaaggaagccattgaagcggctgagcgggcctaacgccttaattggtttatatcggggcgcttataacgccgtatgttaggattgcaaatgaaaatatgcgatgacgagctgttctggaaataatttgttatttctggaacagcttttttgatgccaaaataaatgtcatttttttcgtggaaagtggtcgttgttacgaaactaatgattgaaaggagcgtgaccatgataaatggtgattgaagcagagttgaacgaaatcattcaggcagccgtgaatcagcgggccagtgatatttattggttacccacggcagaagggtatcaggtgttagtgcaagcagcaggcagtttgcgggcacttactcagattacaactgagttggcccagcaattgatgaatcacatcaaataccgtagtaacatggcgattagtgatcatcggcggccccaattaggggcgatgacgttaacattggcagagcaaactttaaatttgcgaatctcggcagttggcgactttttggaccgtgagtcgttggttgtccggttattgtatgaaggtccggcccgaaaattgagctatttggtcccacagcaacggcaacaattgagtcaattaatgcgacgaacgggattgatcttattttccgggccgatgggttctggcaaaacttccacgatgtatgatcttgtgcggcagcttcgtggccaacggctagtcatgacgatcgaagatccggttgaaatttatgaaccacaatttttacaactacaagtaaacgcaccggcccagatggcgtatggcgacttactgaaggttgggttacgccaccatcccgacgtctttattattggtgagattcgtgatgccgaaacggctcggattgcggtacaggcagcgctaagtggtcacttagttttaagtactattcatgcgcgcggtgtctacgggattattccccggttgacgcaattgggagtggaagccgctgttttggagcaggctttaactgcaatgtcctatcagcgcctcgtaccagtgacggatggcagcgtggcgacgattttcgatacggtcgtgttaccgcatgcaatgcccaaaacgtcgcaaatgatgactgaaaggtgggcggagttaattgatgaacaattggcagcgggccgtctcgatcatgcgacggccaatcaacttaaggaagcgtaaacggcttccgattgctatgcaggcgaagctgtttgaaacgctagccgacttgctaggcaacggcttctcgtttcagcaagcctttcaatttacattggatgtagaaggaccggcctttcaatccttgcagcccgcgctggggcgtttagccgcgggtgatgatttgtctatggcgctgcgtccatacattgcggtggacttgtattaccagttcttaattgctgagactcatggtgaattacgccggaccttgatgcaggcaggtcaattaatgcgagtgcgtgctgaacagggacgccaaattcggcggttgttacagtacccttgtctgctgttaattctactgctgggaactttaggcacggtcaaagctgcgattttaccgagtcttgctcatggtggtaatggtagtgggacaatcgcgaattggcaatggtttagcggtatcacggtcattaccttggtgatttgcttattgctggttggccttcaagttagccgattacccattcggcggcgctatcagtggttggctcaagtccccttgattggtcccctgatcagaaactactgtggttactatttaagccttaatgcgggtatgctgctgactggtggtttagggattcgtgacatttgtgaagtcagtcagcactttcaaactaaggcgctgatttatcagcaagggcaggttatcgaacaggcgttactgactgggacttcgttagtcacaattatccaggaggaccgattattacctgatgagttagcactactggtcggcaaagagagtccggcagaacagttaagtcaggaattactatactttgcaactttgcagtacgaacgcttgattcgacagttgaaccggatgattggttggattcaacccatcatgtttggcattattgcactcgccgttgtcggcacatacttgagtttgttattaccgatgtatcaatcaatgggggagattttaaaatgacattattaatgaaacgcttgatgaaaaaaacggcagcaccacagcgcggttttaccttaattgaaatggtgatcgtattggcgatcatcagtctcttgatgttgatcgtggtgcccaatttgaatcaacaacgtaaacaggcggctggtcgccaacaagaagccctgactgaagttgttcaaaatcaggctgaaatgtatgcgaatgatacgggtaagaccgtcacggatgacgacgcaatgttagaagaacttcggaacaagggatatattaacgatggtcaatataagcaggctaagtcacagggcattagtccggtacggccgcaaccacaaaaagtagttggtggttaagcgacagggatttaccttaatcgaaacggtagcggtcttggcgatcgtggctagtgtggcggtgattgctgtgcaccgttttcccacacggcaacgccaacagaatgcggaacaggctttctggcgggagttacaaacgatgtggcagcaacagaccttaaccgctagtgtgacgggtcagccccaggtcgtgagctttcgtggcacggaagtcgtgacttggggtggcaagcgggggcggcctatcagtggcccacagtggcatctcccactgcctgcaacattaaaaacagagcgcggtcgtgatattcaaatccagaaaaatgggcatccacagctagcagtggttattttcaagtcgcaattacagccgaagcagaaaatcagactgaatgctttgatggggtggggggcctataaagtcacacatgttaaagacgcgaatgggttttttgatgattgaaacgattaccgctctggggctattgatgggtggtttgattgggtttgaaagtttagagattatgatgcagtcacatgaacgccagaccttgcaggcgattcagacggccagaaaacaatatgaagaccggcaacgtcagcagctattatccaggataccggagcaagcacatgattaggcggcgcggttttacgttaattgaagccgttgtgtcgttagcaatcgtggccgtagtgctgacgacactttttcaggggcagcgcaatttggcccggcgcacccaagtggatttgccaacagtggattggtatttgatgcttcacgagcttgaaaatccagatcaccattttgtggtggaccatatttccgatgagggtggtctgacgccgggaaaagccgttcatttggttaatacggtcaccggcaaacagtatttattgacttattatcatatcctacatcgaatcggattgcgccactatggtggtggtgaaatcaatctgatgcagggcgttcggcaatttcacgtggccgatgatttgaccctgacgatgacgactgataaggggattcattttcaagcccaattactgttaccagatcggaggacaatggtagatgaggaagcgacgcggaacaatcctgctttcggtgattagcttattgttaattggtggggcgtttgaaacccaacgatacgttaattttcagtctcgccagacgttatatcgcttaattttacaatcctatgagcacccttatcagcataattcgctcccttgattggtgagtgaaccccgtgacttgaacttaacgcgtaaaatcagtaatatggttaaggattacagattttgcgggagggtgagtattctggcacaagcagaaaccgagacgctttttcaggtcttagatcaatcagttcaagttttgatgcaacaactatccgtttcttacgtggatgcgctcattgagactggcgataatttattaagccaatttgtacatgttgaggatggcaagccaaatccggaacagacggcagctttaacaaagctctatcaaacgatcgacttaaaacaattggacgccgaaacaattcggcgtgcgcttcagttggccttactaaaggcgattcataatgatcacgttgatccaaaccatcaaatgacaccagattcgattggactgttaacggcatacttgattgctaagttagttggatcgacgactgatttgtcaattttggatattgctgtcgggactggtaacttattaactacggtcataaatcagttgcagacggaccggccacgtccgattcagggttacggagtcgataatgatgataatcagttggcaatcgccgcgatgagcatggatctccaacgatcagcagtggagttgtttcatcaagacgcaattgattccctggtcatgccgaaaacgaccgttgtaattggtgatttgccagtggggtactacccattggatgaccgtgtccaaggttttcaaacgaaagcgacgaatggtcattcttacattcatcatttgatgatggagcaagcgatggctcatttgttaccgggcggctggggtgttttccttgttccaacgacgatttttcaatcgcaagagtctcaaggactgttaaaatggatgagcactgcggcttacctccaaggtctgttgaacttgccgactaacctttttcttgatgaaaaatcacgaaaatcaattgttgttttacagaaacatggacaacgggcccaccaagcaggtaaagtattactaggcgactttccatcatttgaggatcaacgtgcctttcaagcgtttaccgctcaaattgatgcgtgggtcgaccagaatattattcgctaggagtgtgtcgtttggggaagaccattgccatcaacgctggtagttcgacgttgaaatttaagttatttgaaatgccacaggaacgggtgattgcacagggcgctgttgaacgaattggattcaaaacttcaccggtcaatattcgctatggcgttgatcatcattaccaagagaaagccgtagtcgcggaccatttggctgccgtgaatatcgttttggatgagttaattaaattgcgaattattgactcatatgatgaaattactggggtcggtcaccgggtcgttgctggtggcgagcaattccatgattcagttttaatcactgaccaagtgcttaagcagattacggatctggccgaatatgcgccattgcataatccggctaatgcggtcggtattcgtgctttcaagcgggtactaccacatgtgcccgcggtcgctgtctttgatacggcgtttcatgcaagtatgccggcggttaactatctatactcgttaccgtatgattactatcaacgatatggtgctcgcaagtttggcgctcatggaacgagccatcgctacgtcgcggtgcgagcagctaaattattgggccgaccgctcgaaacgttgaagctgattacgttgcatttaggtgcgggaagttcgattacggcgattgatcatggacagtcactagatacctcgatgggatttacgccgttagctggtattacaatggcaacgcgctcgggtgatgtggatccgtcgctggttgcttatctcatgaaaaagcttaatattagcgatcctgatgaaatgttaacgattttgaatacgcagtcaggcttactggggctagctggttctgcagatatgcaggagctcgaggcacgttatgatgaggactcacaggctcagttagctattgatatttttgtcaatcggatcgttaagtatgtcggtgcttatttggctgagctacaaggtgcggatgcattagtgataacggctggtatcggtgaacgggatgcacggatgcgacaacgaatcgcggatcggttgacctactttggcgtcgcgattgacccgactaagaatcaagtcagtggtgtcgaacgggacctgagtacgaccgatgcgaagattcggacgttactcattcctactgatgaagaacttatgattgcccgcgatgttgagcgcgtggctcagaatcagtgatcagcatcgtttcaatatgattaaggttgtaaagaggcacgcggatgaaaatccgggtgcttttttagatgctaaagtgaaagttattcatgttagtatgcgttgccttcactttattcacgtagcgggagcgttcactggtttagtcaactaacaaagctgaatcccagccatgcaagttagcaaacgcttacgcgtacataagatgaatttcgctagcaaacaatggtatagtccaatcatgtgattttcttaagcgtggccttttgaatgctaggaatttggccgctataataatttcaaggggagtgcaaagataatgacgaaagaaaattcacagcctgcgacggaacaactctcgcgaggcttaaaaagccgccatgttcaattaattgccatcggcggcacgattgggaccggactgttcttaggggccggtcaatctatccacttggcggggccagcgatcctgatcgcatacttagtgaccggtttagtgtgttttttattaatgcgggcgttaggtgaactactgttatctgaccttcatacgcattcttatattgattttattaagcaatacttaggtgataagaccggctttgtggctggatggacgtattgggtttgctggatcacgattgcgatggccgaaattacggctgctggtgagtatatgcagttttggtggcctaggttaccgcaatggcttccggggctgattatcttgattttattgctgggcttgaattctattaatgtctcagcgttcggtgaaactgaattttggtttgcgattattaagatcgctgctatcttggcattaattgctgttgggattggcatggtcttgtttagcgttaagacccctgtgggccacgccagcttaaccaatttggttagttatggcggttttatgccacacggaatcaaaggcttagtgctttccttccagatggtcctgttcagttttattgggatcgagatggtcggcatgacagcttctgagacggctgatccgaagacggtgattcccaaagcaatcaatgatattcccgtgcggatcattctgttttatgttgggtcactattctttctaatgtgtatgtacccgtggcaatacttttcagcggcacacagcccgttcgtacaagtattcaccaatttgggaattcgttcagcggctgcgattatcaacttcgtagtgctcacggcggccgcttctagttgtaatagtgcgttattcagtaccgggcggatgttattctcactaacgtatgatggcaaaagcaagtttgccaaacgaatggggacactatcgacccgccaagttccccgcaatgcgttatggttctcgacgctggtgattgggttgtcagtaattctaaacttactgatgcctgggaaagtcttctcgctgattgcgagtgtatcgactacttgttttatctttatttggggcgcaatcgtcgtcgcacatatcaagtatcgacgtcaagcgggcagtcaggctaaagtgaaattccggatgccactgtttccgttatctgattacttcattctagtgttcttagcttttatcgctgttgttctctgtctgaagtttgaaacgttaatcgcgttactcgtgtcagcggtctgggtggttggcttatacattgtcaagatcgttagtgaccgaattcgtcaacggacacacgactagtcagcaataaccaggagtgctgattggctatcaagtaggttaactaatgggatttatgaagtgcacttaactctgccgattgcagttaagtgcactttttgacgatattagctagatttgtgaatatgggttggtcataaaacatggttccagtgctgacaaagcaataaacttaaaactgttctagtgtcttttagaacggtgcgcggtacaatgataaatgactaacgcgttgtgtcaggtgttctttaaaatggttcatgattaatacgtgctgttcagtaagtgccaaaactgtcagctttgactcggtggaaacggtttgtttagtataaacttgccgagttagtgtgccatatgatgactgacagtcgtaataggattcgaatgactgacatgggtacatgctgacgaacggataagtcagcttttcaagcaaaagtcatgaaattcgctagacatgacacatccgattgatgttacaaatgtaaatatacgaataagaggtttgaacgatgcaatattttacgtccgacacacatttttatcatgctgatttgttgggggacaacgactttgcgccccggctatttccagatgtagagacaatgaaccaagcgattgttgaccattggaatgcccgtgtgacggatcaggatacagtctatcatttaggcgatgttgcgctgtattttacgcgaccagcgaaattgtcttatgagcgggtttttgcactcttagcacagttaaatggcaaaatcatttttataaagggaaaccatgattcacgggccttctttaagtatttggctgctcatgatccacagttgaatggtcaaccgaagtttgaatttcacgacgtgggggtactgattaagtacgaccaccgccaatactatatgacgcactacccaatgatgatggggatcgtcaaacaaattatcaatttgcacgggcatattcatcattatgccgtcaacgtcaaggagaacatcaacgtgggtgtcgatacaccagaagtcgattacttggaccatccggtgccctttggaacgccattttcactggccgagatcgagcagatggttgacggtaaagccattgattttgccaagcgccagtaagcgagtgcttgaccgactttggtgaatgctttaggattaacaaagacaacgattgaggggcgattgaccgtggacgagcaagtcacgattctgcataccaatgatattcattcgcattttgaaaactggccacgtattcaacggtatttattaaccgaacgtgagcagcgccggcaatctggaagccatgtgatcacggttgacctcggcgacgcggttgatcgtgcccatccactctcagaagccactcaagggcaggccaacgtggcgttattgaacgcgattggctatgatgcggttacgattggcaataatgaaggactgggtttaacgcacgcggccttaaaccggttgtatgaccgcgccaactttgatgttgttctcgataatttgacagatactgcaacgcaacgaccgccgcagtgggcattaccagctaaaatcattacaactgcacgggggacacgagtcttgttgctggcatttacggcaccgtttacgttgacttacccgttgaacggttggacgccggccagtgttaagacgcgattcccagagttgttacgacaatatgcagggcaatatgatgtcttaatcgtgatgtcccaccttggtatcaatgtcgatcggtggttagcaaaacagtttccggtgatcgatgttgttattggcagtcatacgcatcatttactggtgaacggtgaactgaaaaatggggtcctgatagcggcagctggaaaatacggtgagtatattgggcgaattgaactgacgattgatcatcaacatcacgttaaagcggccgcggcgcataccgttgccacggccagcttaccaattgtggccggtgatgaaacgttgattactggctgggagcaacagggtgaaacgttactcacgcggcaagttgttgcgaaggtgccgacgcagctgcggccacattggcaccatgcaagtgatttgacggccctcgggctagcggccattacggactatgccaaaactgatctaggtatgttgaacggtggcctgttcatgcgggatcttcccgcaggcatggtcaaccgaaatgatttacataccatgctacctcacgcgatgcatgttattcgagtgacgttaagtggtgaagcattgtggcgcttagtctatgagatggagttagttcgctcgtttttgaacaaatttccgattaaaggaatgggatttcgtggtcaagtctttggttatatccagtaccagggcctcacgtggaaaacgggacagcatacattactagtgaatggtcagccggtcaatcggcaacaaacgtaccagattgcgttattagatcatgatttattcattccgtttttcccgaccattaatatcagtggtcgaactgagatattatttgaagccatgttaagaacggttgttggcgattacttaatgcgtcgatggccggttaaataagagaaaggtggtgtcaatgtgaatcgcgaacatattgatgaactagctgaacaacaagcggaacggcggcgcaatttgtatcatggattacgaactgataagacccactttgaagttagcaagcacccgtttgaaatcgtgtacgattatcgccaagggtttgacctcgacaagttcgttgagcgctacagctcaattttaaataaatatgattatattgtcggtgattggggttttgaacagttacggttaaaaggttttttccgtgatgatatgaaagatgtccagcgctcacagacgattggggcggtccaagactatctgtacgaatattgtaattttggttgcgcctattttatcattaaaaatgaacgggtcattaaacctaagcgtaccagtcgctcacgtaaggatgatcggcggggaaagaaaaacactaatagtcggcaatcccgagcgcggagtaaccgtaacagtagtcgcagcaaacaacgacggaagtctcatagcttcaccactaagcagaaggccgcaccgtttactgaaaagcggcggcaaccggcgaaagttacggccggtaatggtaagcaagcgcaaacaacgaagcagagtagtggtaaacgccactttacgattcgacaaaagtaggaacagagagaggtattttgattgggtaagtacaagggttatttaattgatttagatggaacagtttatcgtggtcgggaacgtattcctgctgctaaacggtttattgaacgactacaggctagtcagactgattttttattggtcacgaataacacgactaaatcaccagaagatgtggctgcaaacttagcgaacaatcatgatattcatgtgagtcctgcgaatgtttatacggcagcgttagcgactgcagactatgttaatgaccttgcaggtgatggtgataaaacgatgtacgtcatcggggaacttggcttgaagggtgcaatgttggaaaagggcttcaagttcgatgagcgcacacctagattcgtaatcgttggtttagactatgatgcgacctaccataaatttgaacttgctacgctggcaattaagcggggggctaagttcattggcaccaacgcggatactaatcttccaaatgagcgggggctagtgccaggtgctggttcagtaattgcgatggtcgaacgggccacccaacaacgtgcaacttacattggtaagccggagacaattattatgcagaaagcggtcgaccggattggtctcgataagcacgattgtgtgatggttggtgacaattatatgacggatatctcagcggcaattaactttgggattgactccttattggtgtataccggtgtctctacccctgaactagtggcacaacaggccgtcaaaccaactaatgagatcaattctttggacgaatgggacctagacgatggtgtggctaaataaatttaaaaatgcggctcagtggctgagtttatacttatggttagtgagtggcacgataattgtaacaatcaacgcgagctggttgtattttgccaatgcggttggtcaaaagttaggcgcaactgtgaatttgacattgggacggctgatgacgaactactatcagctgttagcatatcttaactttccgtgggtacccaaattaactatgaacgattttacggattcgacgagtgcgttggttcacttttcggatgtgaagaatctatttatgcttgattacggtgtgtttatcgtcacgagtgttgtggtctattttttttggcagcgactacgacgtgatcgacaattgtggcggttagtattaccgatgcagacagccctctgggtaccaccagtagtgaccgttataatggctatcaattttgatcagttctttatcatgttccataagatcttatttcgcaattcggactggttgttcgatccactattggaccgaatcattttggtcttgccggatacgttcttcggtcagtgctttgttctagtgtttatcctgattgagtggtcttttttttacttactcagtatcggcagacaagcgttacgtgaagcggattaatgaagagtatttacagtggacactgcattttaagttagattataaaaggccggtcagctattattagctgatcggccttttataattggattaatcttcgttttcagttggatggctaaagcgtgcgcggatagcagagaagacagctggaatcagtgaaaccaggatgattccaatgacaaccatcgaaaagtgttccttaacgaacgggatattaccgaagtagtagccaccaccacaacagagaatgacccacagaacacagccgataacgttgtagcgaatgaattgttgatacttcattcgcgaactggcagctacaaatgggacaaaggttcggatgattggcatgaagcgtgcgatggtcacggtgatgccaccatgtttttcgaagaatttttcggactttgccagctgtttttgattgatcagtctaccaaaccaggatgtttcagttaggcgttctcctagggaatgaccaatatagaagttaagtgagtcgcccgccaaagctgccaccaagaagagaatgacaaaagtccagatatgtaagccataggttggattagcggcgagtgcgcaagctgcaaataaaagggagtcaccgggaagaaatggtaaaatgaccgcgccagtctcaatgaagatgatggcaaagagaattaggtaggtccagattccaaaactattcacgatggtgactaagtgttggtcaatgtgcaacacaaaatcgattaaaaaactcatggttacctccaagtaatgtgaaattaatcctatctaggttaccagaaaatcagtggaaatactatgcttagtcgctaatcgcaagaaatccttacaaatggctagcatttaatcgagttctcttgtattatcaagataatcttaatagaaaacgggtgattttgtggcatttccacaattagatttaagtcaggtcgatggaccaaaagcaacaatcaaaactaactttggtgatattaaggttcaactatttccaaagcaggcccccaagagtgttgaaaactttgttggtttagctcagaagggttactacgatggcattatcttccaccgggtcattcctgattttatgattcagggtggcgatccaaccggtaccgggatgggtggcgaaagtttgtggggtaaaccatttgaagatgaattctcacaagaggttttcaacttgcgaggggcattatcaatggccaacgctggtcctaatacgaacggtagccaattctttatcgttcaaaagccacaattagatgctgggatgagtgatcagatgaagcaagctggttatccggaagaaatcgtgactgcgtatggcaatggtggcacgccctggctagatttccggcacactgtttttggtgcagttagtgatgggatggatatcgttgataagattgcggccactgagactggtatgcaggataaaccagtgaaggatgttgtgatcgaaacaattacaattgaagattagttagtttgaaagaaatctgcagctgcgggtttctttttttgcaattacgattttgcaatccgctgtattcaggttataatattggggattagaattatcgacaatatagaatgaatgagaaaggatggtatgatcgtgagcaattatcgaattggtatgcgggtacacggacgagtcactggtattcaaccatatggtgcttttgtcaccttagatggtgagcatcagggattgattcacatttcagagtgtcatgaaggatacgttaaaagtattactgagtatctaaaggttggtcaagccgtagatgttattattttagatattgacgaatatactggaaaaatcagcttgtcattacgttgtatcgagcatcaaccgcatccgacggtcaatgatttggaaatctacaagacttttcggcataagcatttttggacgaatcggcatgttcatgctggctttgaaccaattgccaatcatttagcgagttggacttcggattcactaaatcgattgaaagcgggtgagtattagtgcagaaaaaagttgccgggacaattatttataatgaccagcaagggtcgcactttttagttaagcattctactaatggatacaatttttatcagttgccagtacgagcagggcattcgcccttagcgtcagtattgtgggatttgcgatatacgattggtattgatgttgaccaattgcgcttgtatgattcgattatggctgagctggatgatgaaaaagttgcggtctttgtctttgaccacctagctgttgacgggcaggtacgtgcaaagtttgatcgtcaagggctcgagtttgttctagccagtgaattgcacgagttatttacgagtgttcgtgtgagtgaaacaatgccgtttacgaatttatcaaaataaattcgaataaagggttgacctgcatactaatacttgataatatatatcttgtcgctgcgagcactgctgttaaacagctagccgctagcacttacattgtttcatttcaaattgttgtaagtgaataaatattcaaaacagcaaaaaagttattgacatgagtaatcgctaatgataagatatttcttgtcgcgttaacaattcaactgattgaggtgttaacgattatgttatggtaataacgtttcaaattcatttgcatagttattcaacttcttaaataaagttgttgacaaggaaatgatgaaatgatattatgtaatagttgtgttaagcgattaacgcacggaattagatctttgaaaactgaacaaagtttcgacgaatcaaatgtgtagggtctcttgattttgaatcaagagcaaaacatttgcgaagtcaattcgctagtgaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaatattacggaaacctacacacgcgtcgaaactttgtttagttttgagagatttaactctcaaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcgaaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattgtctagttttgagagcacaagtttctcaatagtgtggtgacgatggcgagaaggatacacctgttcccatgtcgaacacagaagttaagcttcttagcgccgagagtagttgggggatcgctccctgcgagggtaggacgttgccatgcgaaattggaggattagctcagttgggagagcgtctgccttacaagcagagggtcacaggttcgagccctgtatcctccatcatgagccgttagctcagttggtagagcatctgacttttaatcagagggtcgacagttcgagactgtcacggctcatttaaccgcaaggttaaatggatattattcaatttaatatttagtttcacatagtgtggtgacgatggcgagaaggatacacctgttcccatgtcgaacacagaagttaagcttcttagcgccgagagtagttgggggatcgctccctgcgagggtaggacgttgccatgcgaaattggaggattagctcagttgggagagcgtctgccttacaagcagagggtcacaggttcgagccctgtatcctccatcatgagccgttagctcagttggtagagcatctgacttttaatcagagggtcgacagttcgagactgtcacggctcattgttcacggctcataattaaatagtttcacaaaagttattgttgatttatgtaactgagcatgatatgatgttatagttgtgttaatcgtcatgccgacttagctcagctggcagagcatctgtcttgtaaacagggggtcggaggttcgaatcctctagtcggcattaactgaatagttatgcggaagtagttcagtggtagaacatcaccttgccatggtgggggtcgcgggttcgaatcccgtcttccgctttgttccaaagtgttgccggggtggcggaattggcagacgcacaggacttaaaatcctgcggttagtgataaccgtaccggttcgatcccggtcctcggcacttttatgaagcacccatagcgcaattggatagagtgtctgactacgaatcagaaggttgtaggttcgactcctactgggtgcatataacgggaaatagctcagcttggtagagcacctggtttgggaccagggggtcgcaggttcgaatcctgttttcccgattaagtagtcatatacgattatttaacacatcgcggtgtagctcagctggctagagcgtccggttcatacccgggaggtcgagggttcgattccccctgccgcgataggaattagagcttggacctttagctcagttggttagagcagacggctcataaccgtccggtcgtaggttcgagccctacaaggtccatctactattaatagtggacatttcctagttacatcatatggaggattacccaagtctggctgaagggaacggtcttgaaaaccgtcaggtgggtcaaaccacgcgagagttcgaatctctcatcctccttattatcgcgggatggagcagtctggtagctcgtcgggctcataacccgaaggtcgcaggttcaaaccctgctcccgcaattggtccgttggtctagttggtttaggacgcctgcctgtcacgcaggagatcacgagttcgagtctcgtacggaccgttaagttaatagttctaaatggctacaatggctcggtagctcagtcggtagagcaatggattgaagctccatgtgtcggcggttcgattccgtcccgcgccatatctgtattctgcgggtatagtttagtggtaaaaccacagccttccaagctgttgtcgcgagtccgattctcgttacccgctttttttgggcctatagctcagctggtttagagcgcacgcctgataagcgtgaggtcgatggttcaagtccatttaggcccattttggagaagtactcaagtggctgaagaggtgcccctgctaagggtatagatcgcgcaagcggtgcgagggttcgaatccctccttctccgttgtaccatttaaaaatatgaccccttggtcaagtggtttaagacactgccctttcacggcagtaacatgggttcgaatcccgtaggggtcattatattatcgcgggatggagcagtctggtagctcgtcgggctcataacccgaaggtcgcaggttcaaaccctgctcccgcaattggtccgttggtctagttggtttaggacgcctgcctgtcacgcaggagatcacgagttcgagtctcgtacggaccgtcacaaacgtcattcgttgatgaatgacgtttttttgtgttttcagaatattaactgtttgacgagatcacctaaagaggtgcgcactgtaatcagtaaatagggtgggtgtcattcaacagatggctgattgggctcacgattgctcaactaaagctgacggcagattctttaggatcacactgatcgggacatatgttggttctgactgcgatgtgatgttgtaaacgaggcttatatatcaactgatgagatttagcagtgttgagtaaaagtaatattcatgaaaaaagtcgttgcagttcaatcactgcagcgacttgaaatatccaataccggatgattatgattttaatgaacgtacaaatgaatagcgactttcgtggtagccgtaatctgaggtgatgtacttggcaaatggcttgaatgaagcgcttcgcagccaaacagcatattcggagtcgctatgccaatttgtgacaatcacgaaggctgaattatttttggactcacgtaagatccaaaaatgtttcagcccatctggcttattataatcgtgtcggaaactactaaacttagatttaaagactttttgttcttcttccggtaaatcaatgaagatgaaacttgtcattccatgccagtcagctgatccttttgaaagtaaaacgtcatacgttacggggcttgaaaaaacggttttttcgccggttaaatcgagtagcatatagcgatcttcagtggcgttggcctgcattaataacaagtcacgatcagcattttgttgttggatcatggttagaattttacgtgtcccaaatgttgctgcaatctttccactcatcaatatcactccttatttattacatctattattatacgtgtttttcaaaataattgaaaatatgttaagttgttggtttcattttttcttggtgctatattaaaatagaagtggacagagaaatgaagggatggtcaataatgaaactaacagttcttggttactatggtggttatccatacgatggcgtgggtacgagttcttacctgattacagccggtgattaccatttgttgctcgattgtgggtcgggggcgctaaacgccttagaagagattttagaccccttacagctcgatagtgtgctcctgactcattatcatcacgatcatacggcggacgttggggtcttacaatattactggcagttgcgtgctggtgaacggaagacgcccgtgctgccgatttacgggcacaccgctgatccacttaactttggtgccttgacctgggcgaatgccacagaaggtcgggcctatgatccggctgctgtcaatcagattgggccgtttgatgtgagctttttaccgactaaacatccagttccagcctatgccgttaagttggtcgagcgagcgacggggcaagaacttgtcttttccgccgatacggcttatttgccagaattagcgactttcgcagccggggcacagttattgatgactgatacgaattttgccgcagataaaactggtaaaatgtggcatatgacgtcggcacagtctggtaaaattgccaaagatgcccgcgtcaaaaaattaatgctcacacacttgccacaagatgtctcatttacacaactccaacaagaagcacaagcagccgccggtaatgacattcaagtgacagttgctcaaaagtttttacaattgaatcttggctagtatgatagggcttagcaaatcattttgctaagctttttctgtcagtttaccgttaatagattattgatatcataagtcataattaaattgtatacgaattaattaataacaagaatgactataaaagcggtttattcaatagaaaaaatacatatatcgaataattgtattttaaattattagttttaaataaattaattttgttaaacctattcacaattaaaagtgagtagcgtataatgaattatgttataaaattgattaacgatgccaaggaggacccaggatggttattttatataccgcaccaagttgtacctcatgtcgcaaagccaaggcttggttacagacacacgacattgattttcaagaacacaatctgtttaccgaaccgctttcaattgaaaaaatccagcagattctacaactgactgaatcagggacggaagaaattatttccactcgctcaaaggcctttcaacaactgaacgttgatattaatgatttgtcactcaatgaattgtttgacatgattactcatgatcctagtctgttacgtcgaccaattatgcttgatgagaagcggctgcaagttggttacaatgaggacgagattcgtcgcttcttgccacgcaaaattcggacattagaattattacgggcacaacaattagcaaatatgtgattatcattggctagttagcttaactaattggccaatttttgtattttcagatagattactttacaataaactgaaataagttagaattgtgatagtgattatggcccttgacacttagaaaggggtggatctgtaatggagatggaacgcatcaacgaagatacgattcgcgtcgttattggaaatgatgatctcaatgaacgcggtattcgcgtactagatttactagggaatcataagcaaattgaaagtttcttctatagcatcttggaggaagttgatgttgatcatcaatttcaggacaatgatgccgtaactttccaagtattaccaaaccgaaatggtttagaattatttattagcaaaaacagtgataatttacaagatacgattgctaaagcaactcagtcacccgaccaatcggatgatagcgactcacaagatgatgtttcagattatttgaagcgtaaactgatgcagacggatacgaatcaggttgaagatggacaaggtattgcacataatccaactaaggacactaatgatctcgatccgtatttggatgatcctgatacaccaactaaggaatacgtgttgaaattcgatcaatttgaggatcttgtttcattggcacaattattccggccagagggactcgcgtctaacttattcaagtatcgcgaccaatattatctagaactggttttctttgtcgatcaatcatcaacggccactatcaaagatgatgtcgcagtagccttggaatatgcccatttagctaatatttcagctgacgtactacttgaacatggtgaaaagatcatgtctaatgctgctttggaaaccatccggcactattttaaatagcagttaattgcctcaacataacgtttattcgtaatgttaaggcttttttgtatccacggataaacaatctgcctgccggacgctttgccaaaagacgggtgctgctcggggtcaataaatgatgatgggtttgcgtgagaattggctttaatgacgtaattagttgttgaagggagggaccatcatgttgatcgcgatggatgcccagcatcaactcgttaatgcggcgacggctgatcgccaaatagaatattactgtccaggatgtgtgcagccggtgcgattgaaacggggggcagtgatcgtgccacattttgcccacgtccatgccacggattgtgatgctttctctgaaggggaaacaacggaacatcttcgtggtaaacaacaattagcgacctggttcgctgccagtggttatacggtgcgcttagaggctggtttgccagagatacatcagcgcccggatatcttggttcgacgaggtacagcgcaaccactcgcgttagaatttcagtgttcacccttgtcagtggagcgactcgcagctcggacgcagggctatcgtcagcatggctatcaagtgttatggttgttgggacgcccctatcagcgacaattgcacctcaatagcaaggctttgaagtttttgcagtaccagcaacggtggggcctgtttctactttttttggacactcaaagtactagtgttcgtttattgcatcacgtcttgacattggatacggaaccgctgacctatcaaacgattcgactggatacgcgcagccagtcggtgttacgttttcgccaattggctcctaaaattaacaccccaactttgccggacacgcatttacggcattattatcaacagttaatgttggcacggcttcgacatcaacgtggttttgatgcgttacaagtggcttgctatcaacgcggaggaacgattgtccagttaccgacgtggacgatgcccactgtgccgcaactaccgctgttatcggtaccatatctggtctggcacgcccacgtcttttttgcactgcggcaacagtccggacggcttactgggccacaattagaggcattgatctgggcccaattacggccattacttgcccggcgtgcctgcctgcaagcacgaggcacgttaatacaacaactgataacgaccatgattacgatgcttagcgagcagcaagtgataaactggcagaaaactgagtggcatgtgaattccggccagcttcgatggcgcaaacattgattccggaacagatgctaccgcgataggcgcaatctgtggtaatctagtgctatattgaaataattggaggaatttgcatggtagcaaccaaacaattgccgacccgttcggccgttcctgaagaactgacgtgggatttgacgcccatttatgcagatcaggccgcgtatgaggcggatattgcacaagtcaaagctgcaatccccaccgtcactgcgcttaaagaaacgtttacaagctcggccgacacggtgctggctggcatccaggctgttttagcgctgtatcgtcggttagagaaagtggcggtatacgcaagtctgaaaagtgaccaggatactggcaatagtaccaatgcggctttagacgatcaagctagtagtttgactgccaaggtatccgcagcgactgcctggttcgaaccagcaatcttggaattaacgccgggcgaattggatacgtaccttgatgaaaacgtcgatttacgtgattatcggcatttgttggatacgatccggttgcaaaagggacacgttctgtctgaaagcgaagaagctttactcgcaggcgctagtgatatttttggtgcttctgcgaaaacttttggtgtactgaataacgctgactttcaatttccaacggtaaaggatgacgacggcaaccctgtcaaattgtcacaaggaatttatggggtgttacttgagtccgttcatccggctgttcggcgagaggcgtttgaagcactgtataaagtatacggccagttccggcgaacacttgcttcgactttagctagccaagtcaaggtacacaattttgttgcccaggctcatcattatccagatgcgcggacggcagcacttgctgccaatcagattccgacggcggtttacgattctttagtcacgtccgttgacaagcatttggacttattgcaccggtatgttgcgttacggaaacaactgctcggagttgatcagttgcatatgtatgatatgtacacgccattggcacccaagccgacgaccaactattcctaccagcaggctcaagcaactgctttacaagcgctcaaaattttgggtcctgattatctcaaacacgtcaaaacagcgtttgcttcacggtggattgatgtggtggaaaatcaaggcaaacgtagcggggcgtattcgtcaggaatgtatgataccgcgccatacatgctgttgaactggcaggataatattgataatttatatacgttggtgcacgaaatgggacacagtatgcactcttacttcacgacacatcatcagccttatcagtatggtgactattcaattttcgtggcggaaattgcttcaacgactaatgaaaacttgttgacgaactatttcttagcgactgaacaagatccaaaaatgcgggcgtatgtcttgaattactacttagatggatttaaaggcaccgttttccggcagacgcaatttgctgagtttgaacagtggcttcatgagcaagatcaagaaggtcaggctttgactgccgatcgcttgtcaaaacattatttgcagttgaaccaacgctactacggtgacgccgtcgtcagtgatccgcaaattgccgacgaatggtcccgtatcccgcatttttattacaattattatgtttatcagtatgccacgggttttgcagcggcctcaacgttggctgaccgtattagtacgcaacagacagatgctgttgcggattatctcggttacttgaaagctggttcatctgctttcccaatcgatgtcatgcaccgagctggagttgatatgaccaagcctgattatcttgatgcagctttcgaggtatttgaagaacgattaaatgaatttgaacagttggtcacccaagattaaccagttataaaagcaagcacaatgagcgtcaggatgttcggtcccgacgcttattttagacctgacccgcttatcagttagggtgttagctgccgagtccagaaggcttattctggcagctataaaaggtaaatacagtcaaaagcacccggcgaaaatgatcgtcgggtgcttttgactggtaggaccagttgaataattgcaattactggaattataaaacgtgtaattgtgcgttggcaaggctagcacagctggcattggttgcccgagttgcatcttgaaaaggatccagattgccattgactaagtcaaaaagagtcgtgtaattaaaatgttctagcaagacaccataatcatattggtcgcaatcaaaaacgacggccgacgatgcttcggtaatgttcatttcagatgcaagccgctgatcagcatgaaaggcctgtttcgccaagtcactgtcccgatcttccatgaacatgtctaagtcaatctgacagttagttgcaaccgttttgacgagctcttccgaatagtgttgaccagccttgagcattgcagattgcaaggcaattaaaaagttacgcccccgttttttgccttgaaaaagggcggctttataatccaaaataactcggtacaatgtttgagactgttgattttgagcatgccagtcggatgccttgattccttggcactttagagcccgttgaatcacattaatattgagtaatggtacgaattgaaattggatttgcttgtctgagtcgtttgccaaccgtaacacgttttgctcatcacgtacgcattggtttgccaacggatttacaaataaatacacttctaacacgttataattcctccactttctctattcgcgtcatagtgcagaataccaatcaaacgaggtatttgcaagtttttcatttcataaattttttaatgcagaaaatcactcgttacttagcttaaaccttcacccgtaatcatgcaccgatttgctaaattcgtaaagtattttgtttctaggattacagtttggaaaaaaagtgaacttagggttcaatctcgagaacgttaactttttattccgacgatttatggtaaaattttagggtatggattgaaacggaggtgccccgatggaagattggaatcattttttactgccttatcagcaagccgttgatgagcttaaagttaaattgcggggaatgcgcaaacaatttcgtgatttgaatcagcatgaaccgattgaatttgtaacggggcgggtcaaacccgttgatagcattaaggaaaagatgacccgacgtaaagtacaagaagatcgcctagaacaagatatgcaggatattgctggtttgcggattatgtgtcaattcgttgaggatatctatcaggtcgttgatttattgcgaaaacggacggatatgacaattctggaagaacgcgattacattagtaatgaaaagccatctggttaccgttcgtatcatatcgtgattgaatatccggtccaaatggtcggtggtgaaaagaaaattttggccgaaatccaagtccggacacttgccatgaatttctgggcgaccattgaacattcgcttaactataaatatcaaggggatttccctgaaaacttgagtcaacgattacaacgggctgcggaagccgcctttagtttggataaagaaatgtcagaaattcgtgaggaaattcaagaagctcagagcttgttctcgtatgggaaggggccgggcaacgatgagcctgacacgacaaaggaagatcaaaattcatgaaagtaacgatttttgcaaatgcgagtgccaagaccaagaaagtagcgggtgagttacatactaaactgctggctgccgggtttgaaattgatgatgagcacccagacattgttttgtcggtaggaggcgatgggacgcttttagcggcgtttcaccactatagtcacatggttgaccaagttcgctttgttggcgtgcatactggccatttaggcttctatacggactggcgagattatgaaatcgaccaactgatcaacggtttactggaagacaacggccagagtgtgacctatcccttgctagctgtagatattacttatgcggatacggatgcgactgatcattatttggcgttgaacgagtcaacgcttaagaagcttgggagtaccatggttgccgatgtttatattcaagatgaactatttgaacgttttcgtggcgatgggttatgcgtctccactccaactggttcgacggcttataataagtcagttggtggtgctgtcattcatccgcgcttggacgctttacaaatggccgagattgcgtcgatcaacaaccgagtcttccgaacattaggctcgccagtcatcgtagcgccgtatgaaacaataacgattcggccacaacagcagtcacactttgtctttacagctgatcaaatggatacgcagccgcggccaattgaacaaattcgttattcaattgctaatcgtcgaattgcatttgctcagcatcgtcataatcgcttctggcaacgggtcgggacatccttcatcgggttggacgagcaatgaggtttacttggatcaaccatgagacgaccccgatgaaagttaagacactcttggcacaacatggtgtgacacgtagtttgttgaaaaaagttaagtttcatggtggggcaattctcgttgatgaacgaccggtattagcgattcatatgctgacaggcggtgagactgtgacgatggtcacacctgctgaaattggtaatgaccacttaggcgtctcgacgttgccgatcgatatcttatatgaggatcgtgactacctgattgtgaataaaccagcaggagtggcctcagtaccggcgcatgccttacctgacaataccttagcgaatcgggtaaaaggttattatcaagcggcccattatgataatgaggttgtgcatatcaccacgcgtttggatcgggatacgagcggtatcgttctcttcgctaagcaccattttgcccattcgattattgatcatcaattgaaggcccatgcgatgcgcaaaatgtacttagccgtcgtcagtggtgaattgacgactgaccacgggtggctagatgcgcccattggtcgtgccgctgattcatttatcaaacgaacgacccgtcccgacggtaagccgtctttaaccgagtactgggtggtcaagcggctgcgtaacatgacagtcgtccgggtacggctgcataccggccgaacgcatcagattcgggtgcactttgcagctagcggtcatccattgatcggtgatgccctttatggcggtcctcgtgacccgtggattcagcgccaagcactgcactgcatgcaactggaatttgatgatccattcattagccagaccctcacgacctttgcaccattaccggctgatcttaaccgtttaattattcataatcaacgtgccaattcataaagtgaccattaagatttggtccgttttatgtttatcctaattagcatgattgatgatgaacacgagccaattgatcagcgttgacaatgaccaatttgttcgcggaagagggctcagggcaagttggcttagtgcgggcgcttgtgccaatattagaccattgaataaccgtgattaatggtctaattttttagtttacttcgccaatcaaaaggcgcatctcaaaaaatgagatgcgcctttttggcagttcttagtaattaataatcttggttccatgggcctgtttgacgccgagcgttgtggtgatgtcggcgacattggcggtggtaatgccaccaccaggtaggatctgaattcggccagcggcctgtttgatcgtcgtttgcaagtgggggacacagtcagcaatcggctgatcaagtgggccgccatgtgtcaaaatgcgatcgacgtcatggtctactaaccagtcaattgccgcggcttgttgattttcagggatggcgtcaaaagccatgtggaaggtgatcgacatgccaccggctgcaccaattaataacgctaaggcttcttcgtcaagctgattatccgcagtcaaagcaccaaatgcgacaccatcaacacctaatgattgagcctgtagcaggtccgcttccatgatttttaattccgtatcattataaacgaaattgccaccacgggggcgaatcatggtcactaggggcacgtgatgttcactggtatacttggctgcctcagacattacaccacgactgaccgttgtaccgccaacggataggttatcgttgagttcgatccgattggcaccggccgcaatggctgcgggaatgttagtgtaattttcaacacagacttcttttaataacatgagtttcatcctttactagaaacggacgcaaacgccttcaggcacagtaacgtccttttgtaatagacttagtttaccactcgttaagtcgcgtgcatacaaagtggcattatcagtgttttgattaacgaccacgacaaaggcttcagttggatctaaatcaaaatcacgggggaagtcaccttccgtactgatttgctgaatcagggtcaaatgaccgtcggcggttactgcaaagacagctaacgtattgtagccacgattggagacgtagagaaaatgaccgtcgtgacttaagcggatggctgcggcaccgttgtgcgccgtgtagtcggcaggaatggtcttcacaatgccaagctgcgtaaaggcaccagtttgggcgtcatattttaagctcgcaatctgactcgataattcaccagctaagaaggcgtattggccgtctggactgaacacgaggtgacgtggtccaaagccagcttccatagtgagcagggattgttcacttaactgaccggcgtcgctgacgttatagacatagaccttatcgctacctaaatcgattacggctaagcgattatctggcgtgaggtcggtgtaatgaatatgggagccgtcttgttcaggacgagggccatggccactatgttgaacagtatcggtcaaagtcagcgcgccatcagcagcaattttcatgacttcggccgttcccttatgatagttggcactgtagacgagttgccgggcctcatcgacagcaacgtaagctggtggggtgccaggtgcgacaacggtgtttagtttgtgagcagtttgcccgtcgatttgccaagcagcgataccgccctcgtcatcttccttatcgacactgtataggcaatccttagctgagagggccaaataggtgggattttgagtggctgccagtaagccatcgttggttaaggttttggcagtggtgtcaagggttccttggtaaatcccttggcttgtttttttcgtatatgttccgaataaaatgcgttcttgcatgataacaaacctccttgatagataattcaagtatagcatagatatggcccgtgtaagcgatgacaaattggcgtctgtgattaggactatgctacaattaaagcaattaattaaccgatgggggtctcaatatgacaataactgcaacagtacaatcgattggtgcgaatgctatcgattccaaggaaccaattttagttttattcgatgaaacggccacggcaccattacagcaaatcgcggtgattcagaaatttgagcagcccatcgcgagtctgtcgttagttgctggtagcaccattacgatcgatcgacaaacttatacggtggcctttgcagggggactagtggaagctaatttaacgtcaattgggcacgcgacgttgtacttcaaaccagtacctgccaaaccaatggaaaacggcatttatttgacaccaaaccagttaccaacaatcaaggtcggtagcgttattacgtatcaggcttaggaaggagggattgtttgaaacctgattcacagaaacaacggtggtcagcgcaacggctcattcggattttggtcgttattttattagtattgacgatcttctttatgggcaagcaagtcgattggctattagatccggtccggcaattttttagcatcgtgggtttgccgattattttggccggcgtgctgtactacttgcttaatccacttgttgactggctagaaaagcgttttcgcgtacgacgaacctggacgatcattggtttgtttattgtggttgtcgcgctgttggcgttaggcattattgcgattatcccaacgattcgcgatcaaactttatcaattatcaatgactggcccaattattggaaaaatgccagtactgaagttaatcgctggctcaatgatccgcaactcagtagtatccgtgaccaacttgaaagttggaacacggatctcagtaagctagtgagtggccgcttttcgaagtatttgaccgggacggtgacttcacttacaggcgtatttagtaccgtaacgaccgtcatcattgggttgataacaatgccgtttattcttttttacctattgcgcgatggtcatcaactaccgaagtatatggctaagtttgtacctaccaaagcgcgctcaggattcttagaagttttgacagaaatcaattcacaggtcagtaattatattcgtggtcaattgaccgtggcgttctttgttgccgtgatgtttgcggttggttacagtattattggcttgaaatttgcgctgacgttgggaattgcggctggaatcttaaatttgattccatatttagggtcttttctcgcaatggtgccttcagtggtcattgcgttagtcacctcaccatggatgttggtccaagttctgattgtcttcgtcattgaacaaacgattgaaggccgctttatctcaccgttagtcttagggagtagcttagctattcatccgattacgattttagtcgtcctattagcggctggtaaaatcttcgggttgatgggggttattttcgggattccaggctatgcgatcttgaaagttttgtggacacatctgtttgactggtatcgacggtcttcgggattgtatgaggctgaagcaaccccatcaactgatcaaactaacaagtaaggtaattgttggctactcagatggcgctgaaacgcgattaaaccaataacgccaaattaaaaaggttccacagaagtctgatgacaattctgtggaacctttttaatttaactgaatggtgatgttactaatcattagtgaatatcacgccagttgtcactttaccagcttgcttttttaacacctggaatttgaccagcgtgcgctaagcgacgaaagttaaggcgcgacatgccgaacttacgtaggtaagcatgtggtcgaccgtcaagtgagtcgcgccgatgaatacgcacgggtgaagcattacgtggtaattttgccaattcggtatagttgccagcagctttaagtgcttggcgtcgttcggcatacttagccacggttgcttcgatgcgtttttctttcgcaatttttgatttctttgccatctgaatgagtctcctttatgtcattaaattcatgccattcggtagcaaattcattttgacaatttaagtcagcctttagaacagttaataagataccacacctaaatcgtaacagctactattttgtccgccccgatatggtatgattgaacatacgtcctttacacgatgttgtcatcgtgaatccatagtttcaggtaagctggaaagcatcgcttggatatgggacgcctaatgataaaattaaccaaggtaaggtgacacctgtgaaaaaaattgaccgcggcatccagtttgttcaggcaaatatcgatcgctttcgatgcttagtttgtaatcaagcatacgtgacaattgacggccacagcttatgttgtcctaatgggcatcaagtagatttttcaaaaaaagggacgttgtattttctaacgcatcaagtcgctagcgagtacgatgctaacatgctggcagcgcggcgccgagttttgcaagctggttttttcggtcccattgtccaagccattaatgcggcattgccaaaaacggcgcaacgaatcttagatattggtagcggtgaaggcacccccctagctgatttgttgacaatgcatgccaattctgaagacgtggggattggttttgacattagtaaggatggggttaacttagcgacccaattgacgacgactgcttattattgtgtggccgatttggcccaattaccctttaccgatggggcattcacggccattatggatgtcttttcaccatccgcttaccaagagtttgaacgggtccttgcgcccggtggacagttattgaagatcgtgccaaatcctgagtacttagttgaactgcgtcatttactatttaaaccgactgatcgacagtatcagtatgataatcaacgggtgttagatctgtttgcccagcactatcccactgctaagcggcaacgaattcaataccaagttgcgcttgataacattgactttaacgacttattagtcatgacaccgctgcactggggtgcggatgctgagcagctcgcaaccgctaaacggcaggggttaactaagattaccgttgatgtgagtttattaacgatgcaaaaaggttagcgcgggtgcttgcatgattgaaacgccggtgttaagataacctttgagaaatcgtttggtagttaacatcgacatgtcgttggtgactaccgagttgtacttcattaacgtagcgtttcgccgtgcccacaccgaaatactacgttttttgtttacaatgaaaaattacagtggctttcaccatgaaagagtttgttaatcattaggtttattgaaccaacgtaatcggcttgcgttggtcttttttgtaattgataatccgatgcatcaaccttagaaagtaagattattggatcagcgatatgatgtaaatcgatgagagttttgacattgaatgggtgttttatttttagcaatcggtagtgctagcttgtttttaattgtattgatatttgttgcgttactttatagttaaattgattgcacttttttgcatagtagtttgatagtgttgtgttcatggtcggtatcatatgagaggtgactaattatgtctgagatgttattatttggtggcaatccaccaattttgagtcaaagagccttaaaaattattgatgattttgttaagggaaacagtgtacatgttctagtttatacagtttggcggactaattggaaaccatacatgactaaatatattgagccgataaaatcactaaaaataaacgtcacctttgaatatattctaggtgacgttgagaatgcatcattgcttgataaaatatcagagggcaatattgttatttttggtggtggtgataccatgaaatactttgatcagttttgcaatgaggccaatcggtctaagataaaagaactgaaagaaaaaaatatattatttattgggttttctgctggttcacttttgttggggaatgttggttatgtctcacctttagataatgtctcgggtaagtcagtgctaagaaatgggctgggactttatgataactttgttgttagtgtacatcatgatttatggaatgatacaatggatttttataaggctactgaacatttgcagataataaaattaagcataaacaatgccggttttgtattcaaaaatcttgatggacttttgttaaatgatactgtgttaaaatgcaattaagttcagtgcttcgcggttaataactatataatatagtcgataattgccaatgtttttattgataatttaaaaggtcctcctgattagtcaagtaagacttgtcgggaagacctatttgtattgaatgattaatgcaatttagaagcagatggttgtttacggctgatcaaccaccctaaaccgaaacctagcagtgcgggtacactccagcctaaccctagattggcaagcggtagccacgcgttgagatgaagcaaagcttgcaaccaggatgcttgtacccaggcggatggcatagcgttaatgccggcaagaatggccggaatcatggtccagacaattgtcattccatataaccagcgggacatcccaagccatggtgccagtactgccagtatgattaacacgattgcgagcgggtagagaaacatcagcactggggttgaataagtaatcatttcagttagcccaacgttagcaagaatggctggaatgagacaagcgatggtgatcagccaatggtaggaaatcttaggaaacatgccatgcaacgtatcaccgaaagcagaagtgaggccaatggcagtttttaagcaagcgatgatgacaattagagctagtaaaacattaccgaatcggccgaagtaggcatcggcaacttgagctaaggtaatccccccattggcagctggagcaaagcgacctaagctcatggtacccataatcgccagcaggccatagatgactgccattaaactcatgctgattaggcctgctttaatggtatcagttgcgatttgccccggatcacggacaccgaggtcgcgaatcgcatcaatcacgacgatgccaaaagctagcgaggctaacgcatccatcgtgttgtagccttcagtaaaaccagttagaactggatggctgacataggcgccactcgccgcgacgttaagtgatcccagtggcttaatgatagcgacaagcattaaggcacctaataatagcaaaaagatgggtgtcagccacttaccaacataggtcataatcttaccgggattacgagccagtaaccaagtgacgacgaaaaaagcaacggagaagcccaatagcaccacgggttgtaatttggtggttaagaagggggccagtccaatctgaaaggccgtagttgctaatcgtggcattgcaaaaagtggcccgagggtaaagtaaagcagtacggtgaagacatacgcgtatgatcggctaacgtttgttgccaggtcaaatacgccctgactgcgcgtcagccccatgccgatcacgcctagtaatggaagtccaatcccggtgatcaatagtccgataatggccgcaccaacgtgttggccggcttgctggcccagaaaaattggaaaaatcaagttaccagcaccgaaaaatagtccaaataacatggtgccgatgaagagtaaattccgtcctgataaacggttattcatggtatccccactttcaaataaacatggcaatagtttagcatgctttggtgaagaattaattaaaggtcggtgagggcgttaactggcggtgtaatgcaaccaactggttagtgacaatgttggctacgactgtcgcaatgaggagagatggggcggtggcagcacttagctgttaaatactgccagcaattgcgacgccacaaaaatcccgtcagattctggcgggattaattggtcttatttaaagcgcgtcacagttaactaaattgctcaagtagcgctcggcttgtggtttggctgccactcgatattttagcgctgctaggcaagacgtttactggttagcgactgtaaagcgttcttgatgatgtttgggcgtttccagttcgtttaaaacggctaccgccatcgtgccactattggtcactgattcaccagtagtgttcgtcagtaatgtgtcatggccgtactgggccggggtagcaggacctgctgtgaaattggtggccggggaaattccaacccaatcgacgttggtgacggttcgtaagaaggtcagttcggccagttggttttgcggaatagcgacgaaggcagcattggcgggattactttcaatgtcgtgcacgaagaggtgttgatcatcaccagttgttaaactaccggcccctaagatgaagaggagacgtggccgctgttgttcgcggagctgagcgatcagcttagttgccagatccacgtgtcggtaagccttatcaggactagtcgccattgcgtcaacgaccacgtcaaccgcctgtagctcagatagtgtgagatcgaaagcgtctttagctttggtctgcaaatttgggttagccggtagagcggctagcttttcttcagaacgtccgatggctacgacggtgtggttccgttcaagtgctagtttggtgatggctgagccagccattccggttgcgccaataatcataattttcatagataattcctcctcgagttataaaatgatccgaatgctgccttgtacgtgttaatccggcatgaatcatgatgacaacgtgtcaggtttagattggtgttcgtcagccagtgtgcgtcctgttccgccctccggcgcgtacggtgattagtataggaaagattggttaagaatgcgaacaaagcgttttttagtttcaaagttcgctgttgaaccatagacatggtatgattaataggattgctatgaatgaacatggcgtagagactaatatgaatgaggacgattattttgacaaatcacattgcgttatttgaaccgttaatgccagcgaatactggtaatattgcccggacgtgtgccggaacggatacggccttgcatctgattgaaccgttgggcttcaaaattgatgataagcacttaaaacgggctggcttggactactgggatagtgtcgatattacttatcatgctgacttgcaagattttttagctagtattcctgatttaaatcagttgtacttagtgtctaagtttgctgaacatgactatacggatgttgattatagtgatacgggtaaggatcactatttcttatttggtaaggaaacgacagggttaccagaaccatttatgcgcaaatatcccgaaaaggccattcggattcctcaagatgattcacatattcgagccttgaatttatcgaattcggctgcgattgtgatttatgaagccctgcggcaacaacaattcccgaaccttgaacggtcgcaccactatgaaaatgataagttgaagtaaccaacagaacgtgcactagcgctaaacgttagggtgcgttttttgatggggacgggggaacttgagtttgttataatgaagacagtattaattgagaaaggatgaacgaagcgtggcgcgtagacaagcaacaacaaaaaagcgccggacctcgacgcgcaagaagaagccgacggttgcggctaagcggcagatgacggggaatgtcattggcctgattggactattggtcacgatcctcgccttgttgaaggtggggttagtgggcatggtattcgcagagtttttccgagccattgctgggaatgcctaccagatttttgccgggctaacactcctcgtcatgggatatttgatgatttttggtcggtggccacgactgacttggcggtggtgggtcggtggtaacttgtttttcttcagttacttattgctattagagatcccgatgtttaatcaattgaatcaccataccgatttttggtcgttgacgtggaatctgatcaaaaatgattttgccaaggggggcatggccagtaatcttggtggcggattagtcggcgctgctggctatagtgtcacttatccactattggctaatgtcgggacaattttgatcgcactgatcctgatggttgccagtatctacattacctttgatttgccattccataagacgatgcaagcgttgcgtcaggccttgatgcaattgggccagcaactgcgatccggttatgaatggctgacgcacgtgctccgggttcaaattgcccgttggcgggttcaccaacaagtgcgcgccaatcaagcggcaagtactgagaagcagccaacgtcaaccgtaccacagtcagcagcccctgctgagacaacgagcgggacttcggcgccggactcagcagccagtgcagttacgagctcgcctgccgacttgaatatcacggtggctagtgatcgtgaagcctcgcccataaaatccccaacttcagctgctacggttgatcatgaacaagaactccaagggactgaagtgatggatgatgcggactaccagttgccagagtcaacactattgacgaagattccaaaaacggatcagagtgctgagtacgcaacgattgagagtaactcgcagaagctaacaaccacgttggcaagtttcggtgttcaagttgaagtgaagaatgtcagcttagggccatccgtaacgaagtatgagttacatccagctgttggggtcaaggtcagcaaggtcgtcaatttagcggacgacttagcgttagcgctggcagcgaaggatcttcgaatcgaagcgcccattcccggtaaatcattgattggaatcgaagtgccaaataaacagatttcaacagtgtcatttcgggatatcgttgaggcccaaccagcgcacccgaccaaaccgttggccgtaccgctcggccgtgatgtttctggtaatttagtcgttgccgacttgtctaaaatgccgcacctactgattgctggttcaactgggagtgggaagtcggttgccattaacgtgatgatcacggggctactgatgaacacgaaaccaagtcaagttaagtttatgctgattgaccctaaaaaggttgaattaggggtttacaatgggattccacatctgttgacgcccgtagtcacggaaccgaagaaggcggcccgggcgttgcataaggtcgttgccgagatggagcgacgctatgaattgttcgcggattccaagcagcgtaacatgcaggggtacaaccaatatatccgtcaacaaaatgcggctgatgggcagtcacggcccgtcttaccatacattgtggtggtcgtcgatgaattagccgatttaatgatggtcacttcgagcgaagtggaggatgccattattcgcttgggtcaaatggcccgggcagccggtattcatatgattttggcaacacaacggccgtcggtagatgttattaccggattaattaaagctaatgtaccgtcacggatggcatttgccgtttcaagtgggacggattcgcggacaattattgatagtaacggtgctgaaaagctacttggtcgtggggacatgctgtatcagccaatgggcatgaataagccactgcgcgtgcagggtgcttatatttctgaccatgatgttgaagaagttgtcaactttatcaaagcccaacagacggctgattatgacgatagtatgctggtcaaggatgacgagacggatgccgctggtagtggggaccctcgtgacggtgaggatgagtattatgccgaagccgttgaattggtgactgatcaacagtccgccagtgtctcgatgctccaacgacgcttccgtatcgggtataaccgggcagcacggatcgtcgacgaaatggaggaacgcggcgtggtgggcccttcggaggggagtaagccacgtaaggtttaccgccaaaaatcggccgacgaagcgcccgcgtcgggtaatgacgcttagcgtccagtaagattggtgggcatcatttgaatggcatgacttcacatggtggcgctgccgatacgattgaataatcgacgttaaagtaaaggtttcaatcgttagccagatttgactaacggttggaacctttttcagagacaaatgcgtgatttttttaattcacattgtctcagaagttggtggctaggcttgccgaccatggctgagtgatccaccagtaataaaaaaagttacgcttgttgtgagcaagcgtaacttttttcttggtaagtattgcaaccattcgtggttcgcaaggtgtttaacctagaaggttagtaaacctaacccagataaggcggtaagcaccaatgacccaatggtagaaatgatcattaaccagataacgaccatcgtaattttttgaaaagttgattttttcttcattatgtttgtatgcaccacactttacgagtaattctttcatagtttaacgtggaatcagttttttttcaattgaaattaaaaatagtcatggtttcgtaaatattcgatactaataatgcaaagaataatcgttcctagcatcagccaagtgaaagcgtggacgagaccggcaccaggtaatttgacgttcatgccatagattccaccgataatcgttggaatcgtcaacaccatcgtgagtgaggtcagaaatttcatgacatcattcaaattattggaaattactgaacccactaattgactatattgctgcaaaatctgattggtcgtttcagccatgtcactcgcttgctgggtctcaatcttaatatcatcggtgagtgattggtgattaggtgcgttgaaatgggtgatcgaagtttcaaccgcgtcaagcgtgggtgtgttctgattaagggcggccttaaaacgaatcaaggatttttggtaagccataatggtaaagagttccacgttgtgagtagcttgattcaaacggctttccagggcgcttgtccgttggttgatcaattcgagtgcggtcacaaaactgtgctcgatgtaccacatgatagtcagcacaaaatcttcgtgattatccagacttagcttagaagaggccgggtccatcacaaagtcttgaataaaactagccgggtaattactgacggtaatgaccacttgatccactaaaatcaaggcgaagggatagacttgaaattcaaggtaacccagcttactcgtcgtgagtttgggatactgcatcacgattaagattggttgactggattgcgtggttgataattgctcggctcgtgaaacctccgcatcgtcgaggatggcagttaagtaatctttgggaagatcaaattgtgtgaccagttggtcgatttcagttgaggtcgggcgttcaacgttgatccagtatggctgatcgtgatggtcgtccggcgtagtcaaaaggccatttttaccagtggtaaagtattgtaacaacggtcatccctccagtaatagtttatgtttattatagggctgtcacagatgattgaaaagtttaacgataatctctataatttaacccgacactaatggggaggcaagtacgcatatgcgagatttatggaccacttggtatgggcagctggtatttttagccgccatctcgatgatcattttaggtgctaaacgggttgcacaccgcgtttggccacatggattaagattgttggatttttggccgccatttttaattgttttcacccactttctgacactgcaagcaacggatagttcgctggcaccgtacgaagtgttgtccctaatgattttggggatcggtttaacactgattgaagctgttgaacgcggagaaatcctttactggcgcttttttaagctctattggcggggagcggaattattgacactcgtcgtctatatcctagcacttggcagccacttctttttaacatcgtaaaaatgtcccccactaagtcccacctaacgaaactaacgttaggtgggactttttttgatattttgttaacaatttggaaaagtaacaaaacgatgtggtaggaagtgggggggtgtggtagacttgaattatgtttaatgaaaggggttgattggccgtggcgtctaagatgtttttcggagagtttgaacatgccttagatgcgaaagggcgactaatcattcctgccaagtttcgtgagctattgggcacttcgtttgtcattactcgtgggatggatggttgtatttttggctatcccgctgaacggtgggcaacgcttcaagcacagttagatgatttaccactaactcgcaaggatgcgcgagcgtttgtccgttttttctatgctgctgctgctgaatgtgaattagacaaacagggacgggtcatgatacctgcaaccttgagacaatatgcaaagttggaaaagcaatgtgtgatcgtcggagtttctgaccgatttgaaatctggggtgccgaacactggcaacagtttgagacggagaccgcagcgaacttcgatgatcttgcagaaaacttgattgatttttaaataacaataataatttaggaagggggcgcacgcgtggcaacatttgaacacacaacggtacttttgcatgaagcaatcgccgcgttaaacgtccggccggatggcatctacgtggactgtacgttaggcggcggtggtcattctcgtgaaattttgcaacagttaggtccggaaggccacttgtatagctttgaccaggatcaaaccgcaatcgattataaccaaagtaacttagcgacttatcttgaacgtggtcaggtcacgttcatcaaaagtaactttgccaacttgaagactgaactagatgctcggggccttgaccacgttgacggggtagtttatgatctcggcgtttcgtcgccacaatttgatgatgctgcccgcggcttctcgtatcaacatgatgcgccgttagatatgcggatggatcagagtcagaaattaactgctcaaacagttgtcaatacttggccctatgcggacttggttcgtattttctatcgctatggtgaggagaagttttctaaacaagtcgcacggttgattgagcgtgaacgggcggttcagccgatcgtgacgacggggcaattggtcgaaattattaagaatgccattccagcaagagcgcggcgaacgggtggtcatcccgctaaacgggttttccaggctattcgaattgcggtgaataacgaattgggcgtactggagacttcgctcgaacaagcgattgatttaatcaatgttcatggtcgtgtcagtgtcatcacattccaatcgttagaagatcgtctcgtcaagacgatctttaaggagcacagcgatttgccggagctgccacctggtttaccagttatcccagctgaaatgcaaccagattaccgcttagtcagtcgtaaaccggtcgtgcctagcgatgcggaaatcgaagctaatcgtcgtgctcgcagcgccaagttacgagccatcgaacgtttaaagataacgaataaataatattcaggaataattaaaggagtgattaaaatggcccaaaatggattagcgcgggagttgccacagcaaactcctggcgcaaccaccccggtacataaaacaaaaaccgttgtgaccccgaatccgtccatcaagacgcagcgagttgctttttcattatttgaaaaagtattgtgtgttggtttgagtttggtggtgtttggattagccattatgttagtttcaacgaacattgcaacgagtaacgcacaaagtcagttacagacggtgcaaacgaaagtcacaaaagtgcaggcaaaaaatacgtcggccgcacaagaaatcagtgaactttcaagtcggagccgtttaaataaaattgctaagcagtacgggttatcgctgaacaacggtagcataaggaatgtttacaaatgaataagaacaaacaacgaatgacttcgaaacggtcaccaaaacaaaatcgtagaatttttggccaatggctattttttggcgcgattgccgtctttggtgttttgatcattcgtttttcatatatcgcgattgtgcgccacgtcaacggggtcaatctggtcgaggccaccaagaaactttatacggaagaccagaccatcacggccaaacgtgggactatttatacggccaacggtgacccaatcgctgaagatactagcacgtacacggtctacgccattatggcgaaaaatcagcaaagtgctagtggcaaggcactgtatgttaaaaataatgcgaaggcggcgcgtgtcttatcgaagtatttgccaatcagctataagaaagccctcgcgaccttgcaaaaaggcgcaggtaagttccaaattgaatttgggacggctggtaagaatatttcactgacgaccaaggaaaagatcgatgcccaaaatgtggctgggctgcactttattgaatctgaagcgcggctctacccaaacggcacgtttgcctcccacttggttgggctgaccacctccaagagtcagaaagataccgatcagacgcggttaacggggtcgatgggcatcgagttggcttttaacaagcagttatcgggaaccgatggtcgcaagacgattacgaagagcggatatcaaggtagcactgagactggtaagaaggttaaggatggggataatatttataccaccatcgatagtaagttacagacattactggaaactaaagtttcacaagtaaacgctaaggtctcacctaagtcaatgacagcaacgttgatgaacgcgaagactggtgccattctggcgacgacgcagcgaccgacatttaatgcgcaaacaaagaccggactatctaaaatgtggcgtaatttgttggttgaagacacgtatgaaccaggatcgacgatgaaggtctttacaatggcagcggcgatcgacagcggtaagtacaatgctaatgtaaccgtcccaaccggtgaatataagatcggtaataataccgttcctgattggaatacgagcgggtggggcaatattacctatgctaaggggtttgccctttcaagtaacacggcgatggcccacctagaacaagcaatgggggccaagacttggctgaagtacattaaacgctttgggttgcgtgagagtactaatagtggtcttgacaacgagcagagtggttcaattcaatttacgtatccaatcgaacaagcggatacggcctttggtcaggggattcaggtgaccgctatgcagatgcttcgtggattcacagcgattgctaatcatggtaagatgttacagccgtactttatctccaagatcactaaccctaacaccaacaaaacggtttatacgggtaagaagaaggttgtaagccagccaatcagttcgaagactgccagcaaggtgttggatcatatgcaagatgtggtatataagtcatacggtactggctcatcatataagatcagcgggtatcgcattgctgctaagactgggactgcccaggtcagcaacgggagtacgtatgagcaaggtgacaacacctatctgtactcggtcgtcgggatggcgccagctaaaaatccgaagtacattatgtacattacgatgaaacaaccgacacttaacggaagttccgcgtcagatgacatggcagagatttttgataccgtgatgaaacgggcattggaagaacaaaaagcgagtgagactaaagcgacgacgatcaaaatgaaagatttgacgagtaagtcgactagcgcggccaagaaagctgctaagaagcagggacttgacgtggtcgttgttggtaagggtagtcgggtcgtcaagcaatccatttcttctggcactgtcgtttcaagtggtcaacgcgtcattctggttaccaacgggcagatgtatatgccgaacttatctggatggtcggcaagtgaagtggctgattttgcgacgttgacgggcgttaagctcacgactagcgggacgggttacgtcaagacgcaaagtgtgactgcgggtaatccgatcgaagctaagcaggcaattagtgtgacactgaagtagttatcaagtcttagaatggagaattgttgtgagtttattagtgtggggtgcaaccctaattagtggttttattattgtgtttgcgttaatgccgtcacttattcggtatttccgcgcccgcaaagaaggacagatgattcgtgaggaaggtcctaagtggcatgagaaaaaatctgggacgccaactatggggggcctactgttcattatcgcaatcttagtcaccacgttatgggtcggtgggtggcaacatcagctacaaccaaccacctggattttgatgtttatcctggtcttatacggtgcacttggtttttgggatgatagtatcaagctttggcgtaaacaaaacgaaggtttaaaggcttggcaaaaattacttggtcaagtcattggggcagtaattttaacgttggtctatcaacatgaacatttgccaatggcacttagaattccaggcttgggggtctggtcgctgggaatttggtacatgctcttcgccatcatctggttagtgggcttctcaaatgccgtcaacttaacggatgggttggacggattagtcgctggtcaggccacgattgcttttggtgcgtatgccgtgattgcttacgctcaaaatcagtataatgtgatgttattctgtttggccgtcgtggggtcactattaggtttcttcgtgtataatcacaaaccggccaagatctttatgggtgacatgggatcattagcgctcggtggtgctttagctgcagtatcgatcttattgcatcatgaactatccctcctcttgattggcatcatttttgtcattgaaacggcttcagttatcctccaagtcgcctcgttcaagttaacgggaaaacggatctttctgatgagtccaattcaccatcactttgagatgaagggttggagcgagtggaagattgatatcgttttttggtcgattggtttagtggcagccgtaatcagtgttgccacgattatttagtcacagtttgctaactcgggcattcttgtccgagttagctgtacataattggtctttgcggtatgactttattcattggtggtcgccaagtaaatagtactgattcctatcaacgcaacgattgttctttaaatggttgcgttgtctgccgcagattatgtcgtggaattggtcactggctcaccatgaataatttgctgatgaccacgagttggtgcatcagccacataacaagttaatttaggtatcatctacaaacattatagggagatcttggtttatgaagtcggttgagcagtatcgtaaccaaaaggttttggttcttggattagcaaagagcggggtcaatgccgcacggttgctccacaaattaggtgcgtttgtgaccgttaatgataaaaagaaatttgatgagaacccggatgcacaggaattattgagtgatggaatcaaagttatcacgggtggtcacccgctgtcactactagatgaagattttaaagttgttgtcaagaacccgggtattccatactcaaatccaattgtgagtggggctcaggaaaagggtattccagtcattaccgaagttgagcttgcatcgcaaatcctagcgggagagttgattggtgtgacggggacgaacggtaaaaccacgacaacgacgatgatcacgatgatgcttaatcaacgcacaaatgccggtaaagcttacgtggcaggtaatattggcgtgccggcctcagcaattgcacaaaaggctacggcggccgacacaatggtgactgagctttcgagttttatgttgtgtggtattcaaactttgcacccacatattgcggtgattacgaatatttattcgacgcatttggattaccatggctcacgtgagaactatgtcaaggcaaagatgcgaatcaccatgaaccaaacggctaatgattatctagtcattaattgggatagtgaagaatggcggcaactcagtaagcaatcacaagcaaccgtcgtgccattttcacggcaagccaatacgaaagatggcgcctatgaagaggccggcaagctgtactttaaagatgagtacatcatggatgctgctgatatccggattcctggtgatcataatgttgaaaatgcgttagcagcgattgctgttgctaaacttcaagccgttccaacagcaggaatcgttcaagtcttgaagacgtttacgggtgttcgacaccggactcaatatgtcgagacgtatcaggaccggcaattttacaacgattccaaagcaaccaacttggtgtcgaccgagatggccttgaagggctttgatcagccggtcattttacttgctggtggtttggaccgtggtaatacgtttgaaaagcttgctcccgcattaaaggcgcatgtcaagacgttaatcgtcttcggtgagactgctgaaaaaatggcggacgctgggcgtttggctggtattcaagatattgagtttacggacaactgtgagactgctgtgccaattgcttggcaacatagtcaggctggtgacatcatcatgttatcgccggcttgtgccagttgggatcagtacccgaacttcgaagtgcggggcgaccgatttattaaagcaatcgaacagttaactggaaaggcggaagaaaactaatgcgattaatgatttctggcggcgggacaggtggtcatatctatcccgcactggcactgatcgatgccttaaaagcacatgatcccgaagcgcaagttcagtttgtgggaacccatcgtggactagagagccgcattgtgccggaacgggggatcgattttaaaacaatcaagatccagggatttaagcgttcattgtcattacaaaatgttaaaacagtctatttatttttaaagagcgtggttacggcgcgtaagtacattaaggcgtttaaacctgatgttgtggtcggaaccgggggctacgtgagtggtgcggtcgttttcgcggcgagccagatgcacattccaacggtcattcatgaacagaattcagttgttggtgtcactaacaaattcctaagtcggtttgtggataaaatcgccatttcatttgagagtgcgcgatcacaatttcccgctcaaaaagttgtgatgactgggaatcctcgagcccaacaagtggctaatattaaaaaaagtggcgctttggcgcagtttgatctggatcctgacattccaacggcgttgatttttggggggagccggggtgctgcgcgcattaacgcagcagcggtcgcggcaattcctgaactgaacaaacgtgactatcagaccttgttcgtcaccggccaggtacactacgaaaagattcggaatggcttgtcagcgacagcgctagctccgaatgttaaaatcgaaccatacatcaaaaatatgccagcaattctaccagaagtcgcggttattcttggtcgagcaggtgcaactagtattgcggaaattacggctttagggattccttcaattctagttcctagtccatacgttacgaatgatcatcagaccaagaatgcacaaagcctcgtgaatgcgggggcggctgaactgattaaggaagctgatttgacgggaaccagtttggtagctgcattagatggccttctccaaagtaccacgcatcgtgaaacgatggcggctaatgcgaaaaaactggggatgcctgatgcggccgaccagttactacacgttttagaaacggtgattaagtagcacagagactagagtgaaagggtgggtgtgatggccatttttcataaaaagcccaaggagcgtgagcaccccgagcagctgacaccctgggaacggtttcaacgagacgcggctgagaatcatcgcgcagcgcaaaagagtcaccatagttggtcaggtaaacgcctgcgaattggcgataaattaccgaaactcaaatctcagcgccgccgattacttttcaaacgggtcgtgatcttgatgggctgttttctgatcggtgctggtgtggctggttacttcatttcaccactgagccatgttcagacggtgaccgtacatggtaacgatcaattgtctgttacgcaggtcaagacggcgactaagatcaaccctggagttgccttatggtccgtgattggtcatgatcaacggactactaagcgcgcagaacgtgcccagccgcaaatcggcaaggtcacgactaagttagttggattgaacagtgttcgggtgacagttaaagaaattcgcatcgcgggttacttatcgactggtcaacactatcgacgaattttggaaaatgggttgattttgaaagtgacctattctcaacccggtggcggttcaccgatctatgccaactttaaaagcggtcaccgcttagcaacgatgattgcacagtacgctaagttaccatcggcggtcaaacacaatatttctgagatcaagtttgcgccgaacaaggctaatcccgaacgggttcatctttacatgaatgacggtaatgaagtgtacgcaacaattagcacttttgctagcaagatggcttattatccgggaattgtggcgaagatgaaaaccaagggtgtcatcaatcttgaggtgggcgcatactcctatccgttcaagaatcagaataattgatagaatgctaagtgtgacctttttaaaagcgcttaggatatggtaaactaaggaataactggatatggcagcgaatccttgaatatttatgtaaaatactaggaggttcctctattatggataattcaggaatttatgtcggacttgatatagggaccacctcaataaaagtcattgttgctgaacgtgttaaagggcaaatgaacgttattggtgtgggaagcgcacgttctaatggtttaagtcgtggcgtgatcgtcgatattgataaggcggccgaaacgattcgatcagcagtacgccaagctgaagaaaaagcaagtatcgaaataaaaaaggtgattgcgggagttcccgctaacctggttaaaattgaacgctgtcgtggtatgattgccgtggcagatgagtccaaagaaattaataatgaagatgttcaaaacgttgcggcggctgcgttagttcagagtttaccgccagagcgggaagtactggatgtcatccccgatgaatttgtcgtcgatggttttgatggcatcaaggacccacgtggcatggttggggtccggcttgaaatgcacggcaccctgttcactggtccgaaaacaatcattcacaatacgcggaaggctttggaaaaggctggactgcaaattgaacagattgtgatcgcgcccttggcattaagttccttagtgctgaatgacggtgaacaagattttggttcgatcattattgacatgggcggtggtcaaacgactgcggcagttatacatgatcaccaattgaagtatacttacgttgaccaagaaggcggccagtatattaccaaagatatctcggtcgttttgaatacatcgatcgagaatgccgagaagttaaagcgtgattatggctatgccgatgctcagcaggcctcggatgatgaacttttcccagttgatgttgttgggcaaagtacaccggagcaaataagtgagcaatacttagcagaaatcattgaggctcgtctagaccagatctttgataaggtcaagcagcacttggatgagattcgggcgctcgagctccccgggggcattgttttaactggtggggtggcagcattacccggtatcactgatttggcggcgcaacgttttggaacgcgagttcgcgtctttacgcctaatcaaatgggcttgaggcatccgtcgtttgatgaggcgttagcggtcatcaaatatcaagcggccttgagtgaagttacgttactcgttaagagtgcacttaccggtgatactcgtgccagtgtggcgttggaatttgctgatacaacaccagcacctagccaacccgcagcacaacctaaaaaagcaactaagaaacagtctgcgccacaagcaccacaggaacaggctgatccagatcataagggaactgttgaacgggtcaaaggcttcttcaaccacttctttgattaatatcggatagaaatgacggaggaaaaaacatggaattttctttagattcaacccagaactcaggggctaatattaaagtcatcggtgtcggtggcggtggtggtaacgccgttaaccggatgattgctgaagatgttaaaggcgtcgaattcatcgttgccaacactgatgtgcaggcattacaaacttcaaatgccgaaactaaaattcaacttggaccaaagcttacgcggggattaggcgcaggttctaatcctgatgttggttccaaggctgcgcaggaaagtgaagaggccttgacagaagcgttacaaggctcagatatggtctttgtaacggccggtatgggtggcggtactggtaatggtgcggcaccagttgtggctaaaattgctaaggactccggcgcgctgacagtgggtgttgtcacccgtccatttacatttgaaggtcctaagcgtgctcgtaacgctgctgaaggaattgctcagatgaaagacaacgttgatacgttgatcattattgctaacaaccgtttgcttgaaatcgttgataagaagactccaatgatggaagccttccaagaagctgataatgtgttacgtcaaggggttcaaggtatctctgacttaatcacgtcaccagggtacgttaacttggactttgccgacgttaagacggtcatgcaaaaccaaggttccgctctgatgggtattggctctgctagtggtgaaaaccggacggcggacgcgactaaacaagccatttcttcaccattattggaagtttcaatcgatggtgccgaacaagtcttgctgaacatcacgggtggccccgacatgtccttgtatgaagcccaagctgcttctgacattgtttcccaagcggcaacgactgatgttaacattatctttgggacttcgatcgatgaaagtcttggcgatgaagtccgggtgaccgtgattgccactggtatcgatcagaagcaacgcgaactcaagatggacagccagcctagtcgtagtgaagctagtcagcaacgaggcggcatgttcgcaacgccaactgaccagccagcgacgagtgaagcggcccaatcaagtgagtcccaagctaacgacccattcggtaattgggatattcggcgcgaaccgaacaattcacggccagtcaacaatggtcaagagtttaacaatgttgaaaaaactgattttgatgtctttaatgacaactcacaagctgacgatagtaaggatgataacagtggtgattcgctagatacaccaccattcttcaagcgccggcgtaagtaaaacggtgaagggagcgcaagcacatggccggattcattagtaacttttttggtgttggtgattctgacagtcagtatgaggaacccaccgaagcttcccaagcggcggctcccactgaatctgcaaccaatactcggagcacgccaaaggtagttccaatgcaagggggcaagtcggtgaatagcaaaattgccctattcgaaccgaaaatttattcggacgtgaaagaaattgcgacgcagttattgaaaaatcaagctgtaatcattaattttgatcacgtcgatgatgaaatggcacgccggattgtggattttttgaccgggacggtttttgccatcaatggtgagatcgaacggatcggtgatgaaattttcctctgtattcctgaaaattacgaggtttccggaagtacgacaagtcagtttgatacgagcaaattataaggagtgagtggcctgttagtgacgattattagtcggttgtttcaactgtaccaattagccattgtggtttacattttgatgtcatggttcccgggagcttataatactcgcgtgggccaattcttaggtcaaatctgtgaaccatttctcagtatttttcggcgctttattcccgcaattgccggactggatttttcgccgatcattgcgctgttagtgctccaattagctgaaagtggcctattttatctgataactttattgatatactaaattaaaataacgaggatagtatcgtgaatgataacttaaaacaacattttcgcgatagtgaagccccatttattgaacaggtcactggttggctacggcaagtagctgatcagtaccgaccaatcttaactgcgtttttgaacccgcgacaaatctacattgcgcaaacgctggtcaaccagttagacgacgtgcggatgcgggcatccggtggctttgaaggtgctgagttacaacggatcttattttacccggtgtattacgaacctgaagtggccgattttcaaatcacactgtttaacattgtttatcccgtgaagtttgccaccttaaagcatggtcaaattctgggtacgcttgccaatgccggtgtcgagcgtgatgtctttggtgacatcgtgactgacggaacgacatggcagtttgtgtgcgaaaccgagatggccagctatttcgaggagcaaatcgaccgttttggtaagacgaaagtccacttaacagcggtaccattgtcggcggtgatcacaccggaagacgactgggaggcagttactacgacggttagttcattacgtgcggatagtatcattaaggcggcgttcaacttgtcgcggcatcacgccaaggaattgatcgaaggtgctaaggttcggctgaattgggctgacttaccgaaagctgattacgagttagcattgttagatatgctgagtgtgaaccattacggtcgtgtccgacttgccgaaattagcggtgagaccaaaaaagcgcggctgcgaataacattaaatattattcatagtaaatagatattggaggaattctaatggtgttaagtcctgatgacattcataacaaagagttttcaacgaaactgcgtggttacaatattgatgaggttaatgattttctagaacaaattatcaaagattatcaaattaccttgaagcaaaataaagacctccaagaacggttggactcgagtgaaggtaagttgaagtatttcaatgaattgaaagattccttgaatcaatctatcttggtggctcaagaagctgctgataaagtgaagacgaactctaagaaggaagccgacattatcacccgcgaagctcagaaacaagcgtctgacattgtgagtgaagcaaccgacaagtcaaaccaaatgattgacgaagcttctcaaaaggccaaacgattatccgttgaaactgatgatttgaagaaacaaacgcgggtcttccggcaacgcttgcaagtgatgttagaatcgcagttagaagtggttaagagcaaggattgggatcaactacttagcgaaacgaatacggctgattatgctgaaattcaacacgttttaaaggaagataaccttgacaactcgggggatgcgagcgtaaactcagaagcaaccgttgaaattacggaagcaacgagtggtgagacccccgttgcggacggtggcgatcaagtccaacaacagacggtggttattttccctgatgatgacagcactaataattaattaggcgatcgtcaggcacaattgaagcgaattgaatgtattgaggagaacagcaaacaattaactaatacgcccagagagctgccggcaatggaaaggcagtcgtcccttagttagttgcagatcatctctgaatgctatcctgaattgagtaagggtggccggtccatggacgttaaccatgctaagagagaatttaaacaattctaaaattgggtggtaccacgataacttcgtccctgggtggacgaagtttttttgtgtctaaaaatccaatggcgattgtttgataaaaattttaaggagtgagaatatgcgcgttaaagaaacgttaaacctcggtaagaccaagtttaaaatgcgtggaaacttaccggtcaaagaagttgaacggcaaaatgtgtgggctgaaaataaagtctacgaacaacggcaaaaattgaatgaaggtaagccaagctttatcttacacgatggcccaccatacgcgaatggtgatatccatatggggcacgccttaaataagatcacgaaggatttcatcgttcgctataagtcgatgaatgggtttcgggcaccttacgttcctggttgggatacccatgggctaccaatcgaacagaagttaaagcaagccggttatgaccgcaagaagatgacggacaatgaattccgagaactttgtcggaaatacgcgttggaacaagttgatcgtcaacgtgatgagtttaagcgcttaggcgttgctggtgaatgggacaacccatacttaacgttaaagccagaatttgaagcggctcaagtgcgggtctttggtgcgtttgctaaacgtcacttgatctaccggggccaaaagcctgtcttctggtcatggtcttctgaatcggctttggcagaagctgaagtggaatatcatgatgtgacatcgccatccgccttctacggtgaacatgtcattgatggtaagggtgtcttagatgatgatacctatatggttgtttggacaacaactccttggacgattccagcttcagaaggaatcacaatcgatgcaagttttgattacgtcgttgtgcaaccggctggtgaaaatcgtaagtttgtgctcgcggctgaattgttggacgaaaatgccgaacgatttggttgggaagatgttcaagtgcttaaaacggtcaagggtgcggaactcgaaaacattttgtgcgaacatccttttgacaatagtcggcatttagtaacgatgttaggtgattttgtcacacttgattctgggactgggctagtgcatactgcgcctggttatggggaagatgactatcggatcggtaagcaatacgacctgccaatctttgctcccgtagatgacaaagggttcttaacggctgaagctggtgatgattttgcgggggtcttctacgatgacgctaacaagatcgcactggacaagttgaaggccgctgggttattactgaaatatatgccatacgaacacagctatccatttgactggcggactaagaagccgattatcttccgggcaacgccacagtggtttgcttccgttggtgatatgcgtgatgaaatccttaagtcgatggatgacgttgaattcttcccagagtggggtaaaaagcgtctttacaacatgattcgtgatcgtggtgactgggtcatttcacggcaacgagtttggggtgtacctcttccaatcttctatgctgaagatggcactgccatcatggacgaagtgacgattaaccacgtagctgatttatttggcaagtatggttcgaatgtttggttcgaacgcgacgcaaaggacctattgtcagatggttataccaatgaacattcaccaaacggtacctttactaaggaaaccgatattatggatgtttggttcgactctggttcatcacaccaaggtgtcctggcagagcgctcatacctcgactatccagccgacttataccttgaaggttctgaccaatatcgtggttggttcaactcaagcttgattacgagtgtggctgtttctggacatgccccatacaagcaagtcttgtcacaaggtttcacgttggataatcaaggtcgtaagatgagtaagtcactgggcaacacgattgcgccagctgatgttattaagcagatgggtgctgaaatcgttcggatgtgggtcgcttcagtggataccagttccgacgttcgggtctcaatggaaagctttaagcaagtggccgattcctacaagaagttccggaatacggtacgcttcatgttaggcaacaccgcagactttgatccgaaggccaaccgcgtggcttatgaagatttagcaagtgtggaccagtacatggaaacacggttgaacgaattcgtagctgagacgaaggaccattacgatcattatgatttcttggatatctacaagaagttgatcaacttcttgacggttgatttatcaaacttctatctcgatattgccaaggatattatgtacattgatgccgaggatagccattcacggcggtcgatgcaaacggtcttctacgatgttttggttgccttgacgaagctcttcacaccaatgctgccacacacgactgaagaaatttggccatttttgaaggaaccagaagaatttgcgcaattagctgagatgccagctgttcaaaattatgcgaacagcgacgagttgatggctcaatggacgcggttcatggatcttcggagtaacgtcttaaaggcgttggaagaagcccgggatgctaagttgattggtaaatccttggaagcacacttggatttgtatgttgatgatgatacgcaagccttcttagatcatctgaacaccaatgttcggcagatgttgatggtttcagcattagatctacacgcgttaagtgacgcgcctgaagacgcagaaacatttggtgacacgttagccatcaaggttggccatgctgacggtgacgtttgtgatcgttgccgaatggttaagaccgatgttggcagtgacgaggcttatccgatgttatgtgcacggtgcgccgcaatcgttcgtgaaaactaccctgaatcagtaacaactggtttggaagtttaatctgaattaaatttagcgtgagtcttgataacttatgaaaagtgccactaatcagtcgaacgggactgattagtggcacttttttgtgctggcgtgtggggattatcaagtagtcagtaaatccgaacaccgggatgattgagatacagctgtaaaaaactgattgcgtttttcagatgcaagatttaagagctattaagaatttacagttgctgcgcaggactttgaatggttattatgagaaatggtcctttgcaattgaattttcataaaaaagtcagtatgataatgaagtagtttaaattaaggtcgattttatatagataggatgttgatggctgtgaaaatgatcaaggtacacggttctggtaacgatttttatttattggatcaaacacaatttcaagcaccgttatcggatgcggatttgaagcaattggcaattaacatttgtaaacgtgacggcgcaggtttgtacgatggcgctgatggcgtgttggttgttgataaatcagaacatccacaagtacttggtcggatgcgggtcattaatgcggacgggacggaagctagcatgtgcggtaatgggctacggaccgttgctcgttatttgggcacgcaaaatagtcaggaagacttccgggttcagacgatgtatgcggacttaaaggtgcaggccgttgctgattttgcggcccacgtcccagcttacagtgttgaaatttcacccgtaactttcgacgcgcagacacttggcatgcatgcgaataacgatgcgacgacaattattaatgaaaagattccagcgctgtctgctgacttgaaattctcagctgtggcggtgcctaatccgcatttgattgcgttcgttgaccatgatacgttggttggccccgaattaggacgtatcggtgaatggatgaatgatggtaaaaaccaaattttccctgatggcgtcaacgttagttttgtggaagtcttaggaccaaattcaatttttgtacgcacgtttgaacgcggggttggttttaccaatgcttgtgggactgcgatgtcggcttcctcattgatgtacgtgttattacaccaagaaagtaccgattttaatcaagaaatccacgtcaccaatcctggtgggatggtcaaaaccgttgttcaccaaggtgccgatgaagaatactggatggaattgatcggtaacgcgacgttcgtccggatcgtgactttgccattagaagatgcgcttcagggcgactacagcccagctaccgcaacggaaactggtgagcaggttgcttatgaagatttcgtcgctaaccttgcaaaggcctaatggcgattagtgtcaattggtccgcttgattttaagaattggaaaaatgggttaaggagccaaattggtcgctcgttagcccattttttgcgggttcgttaaaattaccgaaatcgcccagttgaaaattgcaatcgagctaaaaaatcggtatccttattgagagagcagacactgaaaggggttcttgatcaatgacatttgaggaacgggttcagagtcgtcagttggtttatcaaggcgggttggtacaggtcgaacgacaagaagtcactttaccagatcaaacgacggcaacacgtgaaattgtgcgacaccagccggccgtcgcgatgctgatgattaccgcgcaacataaaatgattgttgaacaacagtggcgcgctgcaaccggtgggctgaccgtcgagattccagctggtaaggtcgaacccggtgagaccatggaccaggcggccgtccgcgaattaaatgaggaaacacgattgacagctcagcacttagaagcagtcgcccaattctacacgtcacccgggtttacggacgaactaatgaagttgtacgttgctaccggtctgagtgcggttgcaacggcattcccacaagaccctgacgaacaaattaggctcatcaagctggacctcgcgacggctgtcagtcaagttcagactggtcagattcaggatgccaaaaccgtaatggcgatttggtactggcaaagtcaccctgagttaggagttgaagcatagtggcagatgatgatcgactcaccagacagcaatatcgacaacaacgtagccagccaactggtcacgatactcaggaacaagaatcaccaacggccgaacccagtgcatcccgacaagcgtatgctgctgagaacaaccgggctgttgaagaagccaagacgaaacggctagcccgcaaattgaattgggcgattgctggactagtcgttgggattattattgtctttttaattttatttttaacaccatagaaagtaggcgctaggctcacatgaaatttggaattatttgtgcgatggaagaagaacttaaaacgttacgggatgctttgcaagacgaaaagatcgttaatattaaggatattacgttctatgatgggacaattgatcagcaggaagttgtcttagtgcaatcaggcattggtaaagtgcaagctggtatgactacggctttaatgattactaactttgatgtggacgttgtcatcaactctggttctgcaggtgggattggcgctggtttgcatgtcggtgacgttgtcgtagctaaggcaactgcttatcacgatgttgatgcgacggcctttgactacgaatatggccaattaccacaacagccactatactacgaaacggatgccaattgggtaaagcaaatcatggcggcggccaaggcaaccggtttgaatgccaagactggactgattgtttccggtgaccaatttatcgcaggtaaggcggctaccgataagattttagcacactttccagaagcactatctagtgaaatggagggcgccgcaattggtcaagcttgtcaccagttccagacgccatatgtggtgattcgcgcgatgtccgatgtcggtgatgaaaatgccggtgttagttttgacgaatttatcctggaagcgggtaagcagtccgcagcgatgttacttgcattatttgcggcgcaaaattagtcagatgtatcgcagcgatgctaataactaagaattatttagaaggaagtatgatgtaatgaagcaagtgtacctagacaatgcggcaacgaccccaatggcagcgtccgttattcagacgatgacggatcaaatgacgaatacgtttggcaatgcttcaagcacccacgcattcggtcgggccgcccgtgaagttttagacgatagtcggcacgtgattgcccaaagcattaacgcagctgacgatgacattatctttaccagtggtggtacagaaagtgataatacggcggtgatgcagaccgcgtggacgcgccaacatttaggcaagcatattattacgacggcaatcgaacatcaagcaattcttaaatcgactgcttttttggcagaacatgggtttgagattacttatttacccgtgaatgaacagggacaaattagtctggatgatttgaaggcggcactacgtcctgatacgattctcgtctcaatcatgaccgggaataatgaagttggttcacagatgccaatccatgaaattggtgaattgttaaaggatcaccaggcatggttccatacggatgcagtgcaggcctacgggttgttggatattgatgtgcaacgggatcatattgacatgttgtccacctcagcacataaaatcaatgggcctaaattcttgggcttcttgtatagacgcaatggcattaactttcctagctttgtcaagggtggcgaacaggaagataagcgccgtgccggtactgaaaatatcccggcaatcgcgggctttgccacggccgtgcaagaactgacgaccgctgagaaagcccaccggcaggctaagtatcgtgagttcaagcaatacatcgttgaccagttaacggctaacggagttgattttgaagtcaacgggtccctcggtgagcataacttgcaacacgttttgaacttatggatcaaaggggtatcgacctatacaatgcaaactaacctggacttaggtggtgtcgcagtttctgggggctccgcatgtacggcggggagcctagaaccatcacacgttttaattgcaatgtatggtgaagactctccccggatcagcgagtcgattcggttgagctttggtcgctatactactaaggctgatctggatcagtttgtaacggtgctgacgaagacgacgcagcgcttattaaaaaagcagggggcgtgacgatggcatacacaacaacggttaaactagatggggatactaagacgtatacgctgagtccaacggtcaagaaatacacgttgatggatttgggttttgtgaagggtcgctcgggcgcgtttagttttgaacgttccttggatcccacttcaccctatcaagcggctttcaagctgaagatgacagtcaatgcggatttgactgggtttaagatgacgacggtaacgggcaatggtgtccaacgggcaaatattttcaaaaatgacgcccatccggaagctgttgaacaattacggtatattttagctaactttattgaacgggatgtcctcacgacggactaatcagggaacgcctggcttgcagccggcgttttctttgttataatggaacttactggacttgtacgaccttcaaatcgtggattctccagaatcttttggaaatgatggtgaaaagtatgactgatcacagtaacacgcgtgtcgttgtcggcatgagtggtggtgttgattcatccgtagtggcgttgctcttgaagcagcaaggttatgacgtggtgggcgtgtttatgaagaattgggacgatacggacgaaaatggtgtctgtaccgcgaccgaagattataaagatgttgccaaagtggcagataaaattgggattccttattactcgattaacttcgagaaggaatattgggaccgggtcttcacgtacttcttagacgaatacaagaagggacgcacaccgaaccccgatgttatctgcaacaaagaaattaagtttaaggcgtttttagattacgcgatggatttaggggcggattacattgccactggtcattacgcgcggttacaacatgatgaagatggcacgatgcaccttttgcgtggtgttgacagcaacaaggaccaaacttatttcttaagtcagctggattcgaagaccttacaaaaggtgatgttcccacttggcgaaatggtgaagcctgacgttcgtaagcttgctttaaacgcgggcttggcaacagctaagaagaaggactccgttgggatctgcttcattggcgaaaagaacttcaaggaattcctaggccattacttaccagcaacgcccggtaagatgatgactttcgatggtcaggtgaagggtgagcacgccgggctgatgtattacacgatcggccagcgccgcggacttggtatcggtggtgatggcgaggataacgagccatggttcgtggtcggcaaagacttgaagaagaatattctgtatgttggcaagggctaccataatccgcacctgtacgcgacccacttaaaggcgtccgatttacactttgtgactgatgaagacttaggtaatgacttccacgtgacggcaaagttccgttaccggcaaaaagattctggtgtgacggtgcattttaatgatgaccacacggaagttaccgtgacttttgatgatccagttcgggcgattactcctggacaggccgttgtcttctacaacggtgaggaatgcttaggttccggtatgattgacgctgcttataatgatgagcgcgtcttacagtatgtttagttcgtaattggtttaccgctgatcaagctgagcttgattagcggtttttttgtatgtattgggtcggccgtggccggcgtacgtcaaagcttaggtcggacttgcttttcttggctaggttgattaagctaaatggagtatgatcaatcggactgattggttataatcgataagctgttgtgggatggaatgattatgagacaattagcacattttaaattttttgatacgctatctaagaaaatggtagccggttttattatcttaattctgattgggacagtcttactgagcctcccatgggcgacgccagcaaacgtgcacacgtcgttgatcgatgtgttgtttacgtcggcatcagcgacatgtattactgggctgaccgtcgtcaatactgctgcgcactggacaacgtttggtcaattggtgattctggtactttcggaggtcggtgcgctgggctacatgacctttgcggtactcctctttaatattatgcgtcgtcagatcggtctctccacgcagttgatggtcaaggcctccctgaatttggaacgattgagtgatactaaaagcgttatgaagtatgtcgtgggtttgtcactgctctttcagctaggcggtcttgggttgctcgcaattgattttgtacctcgatttggttggcgtcacggattgtatgtgtcactataccatgcggttatgtcattttgtaatgccggttttgatgtgtttggcgatagtctgcaaggctttcgtaatgatccatacgtcttgacggtcacgatgatcctaattattgcgggtggccttggatttttagtttggcgtgacgtgctgctgtaccatacgcgtaagcgactgactttaaattccaaactgaccttactcacaactttcagtttatttgtcatcggttttgtcttgttgttgatcactgaacgtgacttggaactgttgccaaccggaatgtcgtgggtcaaccgaacgatcaatacgctgtttttaagtgttacccccccggacagcgggtttaatcacaatgcctactcaaggattgcaagcggggagtttattggtcattatgattctgatgttcgttggtgggacgcctggatcgactgcgggtgggatcaagacgacaacgtttggcgttttgatgttccaaagtattgcccagctacgtggtcgccgtgatgttgagtttagtcatcgtcgttttagtcaggagaatatcaatcgggcgctaatgctgattttcttggctagtattgtgctgacagtggcaacactgatcttaacgcagactgaaaaaattccgaagggcttcgggttggaatacgttttgtttgaagtgttatcagcatttggaaccgtcggactcagtttgggattgacgcccaatctgactttgattgggaagattgtaatcatgatgctaatgtttattggccgggtggggatcttcacgtcactctacgcgctttccagacgtcaagctagggtgaacttgatccgttatccggcagaaaatattttgattggttaggtgggcaacatgcgaaaaagttttgctgtatttggtctaggacggtttggtgagagtgttgttcgggcgcttgccgcagctcatcaggatgttttggccgttgatattaacgaagaaccagttaacgagctaatggacgtggcgacacagacaatgattgctgatacccgtgacgagcaggtgttgcgtgatttgaacgtcgatacgtttgattatgtgattattgggattggcaataatatggaagccagtattctgacgacgatgttgagcaaggagcagggggcgaaaaaggtcatcgccaaggccgaaactagcgaccaggggcgggtccttgaacgggtcggcgctgaccaagtcgtatttccggaacgtgatatgggtcagggcattgcccaccgcatcctttccaaccatattttaaactttattgacttaagtgatgagtatacgttggccgcaatcgagattacggatccgaactttgttaatcagaatctgatcgatttaaagatccggcaacgttttggtctgacggtaattgcaatcaaacacgagaaacacattgatgtctcgcccaagccgacggatatgatggccctccatgatgtgattactgtggttggtccagttaagggcgttattgcgttagatgaagcgttaaaaaaataaatgaattaatgatgtaaaaacatcaaggacaacgggccttgatgtttttttggttacaagggtgactgggtatccacgttgtggccggttatcaccaggcgtttaattaatatggaaagttaatgaatcaaaacataacccacagtttcgattggtatacatgataaactatggttggcgtcaggggaagaggacggtgaaagcggaatcataaagtgattagtaaactaatatggtagcaggcgactggaaaagcagtcgattgagaaggaggaagcaacatgcgaacttttaaattaatgaccgggttgagtggtggcgcaactttactatcacttgcgctaatgcccctagcggcgttagcggccggacccggaacagcaagcaacaatttgacgacagtttcgtctggttatgttgcggatagcacgggtaatgcggaagcgttatcgaatgcacaatttacggttatgcccggtgaattaacgttggatgctgtgccaaatatcgcgttaagttcgaccaacgttaagaatattgcatctgctgccacaacgttaaatgcaacaagtagcaatacgtcgggaggcagtggctatgatggcaatggtagtggcaatttaaacgttagcgactttcggggaaatcatgctggctggacgttgacagttgggatgggaccgtttagttcgggagcggctaaagttgactcggccacattgaatttgaatatgaccaagggtaacgctgacaatgctaatactgccgcgccgaccgcattgagtttgaatcagagcgaagtgacaaacggatgggtcgcgagcccacaaacgttatggaatgctgctgcagatagtggtgaaggttcaaatacagcgacgactgccacgagcagttcattgcaagtcggtaagcagtccaatatttctgctggaacttacacagcaacgctttactggacgcttcaaaatgcaccagcagctgctgcagcaacaccaaaagcagcttcataggttcagctgatcatcgcgcgtcgttattcaatgattaagtgaagtgggggtgtttagaatgcgatggaaacaaatcggtcagtggtggttattagtgttggcattgctactaggcgggcttttagggtcattacctggtcaagcggcatctaacacacccgcatcgggttttattctgacacccctactgcccaaggatcaactagataagcaggcgggttactttaatatgaaggtcacgccgggaacgacgtcaacgttcagagtctccgtcagcaatcctggtaaatcagcaattacgttgcaggtaacaccggtcaacgcaacgacctcagatgcaggcagcgtcgcgtacgtgccgtctaagcggcatgacccatctgccacgacgacgtttactgacatgacgtcaagtggcgtcgtagttaagttagcggctcatcaagcgaaaacggtggcttttaagaccacgattcccaagtctgggttccaaggggaggtgttaggtggcctctttgtcaccaatccaaccgccaatgcggcccggccaacgacgagtcaaggttttatgttgaagaatcgctatgcagaggttacagcggtggcgctttggtgtcagccgcaagtgacgattccagttaagttagtcctcgatgaagtcaaagtgacgcccaccaatgggcaaccagtactctttgccaaactccgtaatctgacgccgacactttttggacaactcaaaattcaagcacgcgttattcaacgcacgacgggaaaaaccgttgccacgcagcaacttaaatcaggatcaatggcaccgaatagctggtttaactatcaagtcgcgttgggcacgcaaaacttagccgcagggaagtaccgactaaaattgcatctaacgagcggccagcgtgtctgggatttcacccgtgactttaccttgactgcagaacgggcgcaacaacataatcatcatctggttggaccgcgtcaggtcaactggtggctgtggggtgcagtggcactagtcattctcttagcacttctaatggcggcgtactggtttggccagcggcgttcgcgtaaggagtgaggaacgatgagaaagttgatcaaggcttgtggcctaatggtgataagtatgctggttggtttaggtatcgtcacgagtgccttagcagccaaaacggcgccccaatcgccaagcagtccaccgagttccgtcttaggcttgaatctatcgggcggtttttcacaacagccaatcgattcaaatgtgattggtggcaactcagtaacgctgtcggttcgggcccagcgcagtgcgcttgaggcggcgacaagtctgttgagtggtcgcaagtacgtttggtgggaatcgacggatgaggggcaaacctatcagaagattggcactaatagtcgaacctatactttcaatgcgccgcaagtgaccaaaacaacgcatctttattttcaggtccagtatgatttctctggtgttggggcgtttcctgattattggtccaaaatcgcgaaagtgacggtcacgccagcccgggtggtaacgactggcatcaaagtgacgagtgatgacgcgtggctcaataatgcacaaacgaccatggtacatgcagcactgacgccagaggaagcaacggatccaattacttggaagagtagtgacccgtcacttgcggcagttgatgaatatgggaatgtgaccgcagcggatgccgccacggataattccggaaaagcggatgatcacggaactgtcacgattaccggaacctctaatggtctgagtgatagcgtcaaaattttggttggagcgttacaagatgtgacggtcgtaaaagggacgccggcaacatttacattaccagcattgcccgaggggatgactgttagcaattggtatcgtgtcaagaatggtaaggctacagccctcaatgtcacggatacgagttatacggtcaaggtaccgatcaatgcggatgatgatggaacggcctactatgcgagtctaagctatccggtcaatggcaagccacagacggtgacgaccaacgccgctttgctaacagttaagagtggtgggcggttatcattgagtgccgttcctaattttaattttggaacgttaaacctgcagcgacttgcacaaggcactgacttggcgacagacccgacggccgtaaaagctaatgacggttatgacggtaataatgactatcggttggccgtggttgatgaccggactgttggggctgactggcagttaatggcgagtctgagtccctttactgctggaaatacaacaatcaagacggctcggttaatgctcaaagactcgacgggagtgctcaatcaaacgataccaacggatggttcgacaaccagcgtttaccggcaaactggtcatcagagtcaaacttttgatgtggcacctagttcattacagttaccagcaacaccattggcaacgcctggtgagtatcaaagcattattacttggaccttggcgattgtgcccgctgcataataattagtggtggtaagtagtgtttcaaagctacttaccacttttttggggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgctggttcttgataaagcttttaatattggtcattagctgaggactgacattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcgcaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagctttgcaagcacttgtaagcttccgttagtagcttcttgaacaactaaatcagtaatatttgggtctttaatttggagcagtactttagtagaatggtctagggacatatctgacactcgctttcaattggttttggtcgacttgattgtagcacaggacgatatgtccttttgttgtacataaaaatagtgttgatggattttatccatcaacactaaatatcatagaccccttttttgttaaagcagggtaatgctggagttgaacttggttcggctgatttagtttacataattatatttttattaagtagattggaaaaacgacgatttactcttacggctgagtagtacggtgaataacagccattggcagtatggcgtagcagttgcatacttagtggctaaaagataccatgcccggtcaactgatcgcgtttatcaaataatagtgtgatgatcgttaaaattcgtgaacagattttgaaaatcagtctgaaaactgtcataatatagaacgtaagacgtgttgcgagcgtgacgaagtatcacgaccatccgccacgtcatttgaagtattaacagggttggcctaacggcgattgacgatgagttgcaatgatactgctgaatcatcgcaaccgttattcagtttggaggggccattgctcgaaataagatcaaatcaagacactagagtaaggaagtaagcaattgacaaaactattatttgttcgccatgggaaaacagagtggaatcttgaggggcgctatcaaggctctcagggagattcaccattattaccgactagttatcaagaaattcatgaattggcagcggcgctccaggatattcggtttagtcatatctatgtcagtccgttaaaacgggcgcgtgatacagcgatgacactacgtaatgatttgacacaatcagagttacccataacggtattgagtcgtttacgggagttcaatctcggtaagatggaaggaatggccttcacggatgttgaagctacgtatccggccgaattcgacgcgtttcgaaatcatccggatcagtatgacccgacagcgattcagggggagagctttcaacaactgctgaagcggatgactcccgctattaagcaaattgttcaagcaaatccacgtcgcgatgacaatgttttgatcgttagtcatggtgcggccttgaatgccttggtcaactcattactgggagcgacactggcgacgttacggcaacggggtggcttgtcgaatacgtcaacaacaattttagagacgcgtgaccgtggtcaacattttaagctattagattggaatgacacctcatacctatcacggcggcccgatgcaactgatacgatttaatatagaaggaagtggttcggatggcaaaaacatcacgtcctagcaaagctaaacagcaagcactagtccatcaactcattggtaagattgatgcacagcccgaggactaccatgcttattatgaactagtggtattattaacggctggtcaagattttgaacaggcagaggcgttagcaatgaaggcgttgggaaagtttgaccaccaacaacccgcagccgactacctgcgttatgcgttgggaaatgtctattatcaagctcaaacttatgacaaagcgttaccatattatcaacaaattacggatgatcaactaaaacaggatgcttatttaatgagtgcacaagctttaatggcccaacacgattaccaacatgccctagtctgggccattacggctcaagaggcacgtccacaacaacttgacgctaatttgttagtagcagacatattacttgcattaggcaataatcagcaagcatcggattactatcaacgcgcatataagattgattcgcaatctgggcgagctgcttttaaccttggactgaccgcaatggtactggggaaaccgtatgccacctggtttgaacgcgcgcagaaattggacagtcaatattttaaaagtcatcagcaacagctaacggatattgaaaaaatgttagccgcacaagcagataatcaaaatcactaatttaggaggatttccgtgacggacgaacaagcacatttattttccgacgatattggtcgggaaccggtcacacactttatcgtcggtaaagtcgctgccgttttttttagcagtgccgatagtttttataaagtcttattagtcaaagtaactgaacagaacattgattggtcggaagatgagatcgttgttactggaaattttgcggatattcaggaggagacaacgtatcgttttaccggtaaaacggtcacgcatcccaaatacggggttcagtttcaagcggataattatcaaaatgaaacgcccacgacacgcgcaggcttgattgcctatctatctggtagtgattttcctgggttgggtaagcggactgctgagcgaatcgtcgatactttgggcgaagatgccattgatcaaattttagctgatccgaaggttttaaaaccaatcggacttcgggccagcgttcagacgactttgatcgacacgctcacggtcaataacggtttggagcaaactatcattggacttaatgcgtacggttttgggagtcggttagctgcggccatctatgcacgctatcaaggtgacactttggctaagattcaagagaacccgtactgtttggttgaggatatcaaaggcgtcgggttcaaaaaagcggatcaaattgcggcccaacttaaaattgatccccaagcggatgaccggttaaaggcggccctattgactgagattaatgagctgtgcgtggaaaacggtgatacgtataccacggctcaaccgttgctgaatcaaacgttgcaactacttgaaaatgctcgcaatgttcaaattgatccttcgaagctggctgatcagttggtcgtcttggcgaaggaaaataaaatcgtgggtgacgagaatcgtatctacttgcgcggcctctatgaagccgagtggcgcgttgcggaacatttacaacggttgttagccgccgataatgatgaaaaattgtctgaacgtgccgtggatcatgctatcgagcatgtcggtcgagctagcaacattacttatgatgaatcacaaaccgaagcactaaaagcggcaattacggcgcctgtttttctactaactgggggaccggggactggtaaaacgaccattatccgtggcttagtcgcgctctatgcggaattacacgacgttgcactagatatcaatcagtataaggataagccttttccaatcctgctggcggcaccgactggacgggcagccaagcggatggctgaaacgactgggctcccagctagtactattcatcggttgcttgggttgacggggcgtgaagatggtcccgaggagcctagtaaggaattagatgggggcctcctgattattgacgaaatgtcgatggttgacacggtactgtttcagcagttactgacggcgattccaagtcacatgcaagtcattcttgttggcgataaggatcaactgccatcggtaggagccgggcaagtgtttcatgatttattgcagtttagtgaactgccccaaattgagttaacgacaatctaccggcagggcaatgattccagtattattccgttggcccacgccatcaaagatggtcatttaccggccgattttgccgtcaaccaaccggatcgctcatttattgcctgcaacgcttatcaagtcaatcacattgttgaacaagttgtggcacgtgccaaggcgaagggcttcagtgctgaggaggttcaaattctggccccgatgtatcgcggcactgccgggatcgatcagctgaataccacggttcagaaaatctttaatccgttgaagagtgcccatcagaagcatctaacgtataacggtcaagattttcgggtcggtgataaggtcctgcacctcgttaattcacccgaggataatgtttttaatggcgacattggtaaaatcgtcggtatcgatctggcaaatgattctcacaatgaatcgaagaaagaccagatcacgattgcctttgatcaaaatgaagtgacttatcaacgcaatgaatggaatcgattgacattagcgtacagtatgtcgatccacaagtctcaagggagccagtttaaaatggtgattctgccactggtaccacaatttgcacggatgctacaacgcaatctactgtatactgccgtgacacgtgctgaacaaatgctgatcctgttaggtgatagtcaatcatttgagcggagcgttaccaatgaatcggttaatcgccaaaccacactgacgaaacggttacaacaagtctttggcggggataccgtatccgatgaaacggccactattgcgactactgaccaagcagaggcaatgccagccggcgaaaaagcgacggcggttaagaaagttgcttctgacgaggagtcggccactgaaaaacctcaggaaccgagttcccagtctgctggaccaacaattttgacccaagcgctagtcagcgctggccgaatcgatccgatgattggcatgaatggtatcacgccagctaatttcatgccgcaagtagctaattgataattaattggttattgcaactgaaattacggtgaacgacacattgtcggcgacgctcattatgcaagaaaatttgcttgtgtgcggtttttagccgtggttactgctataatcaaagtagcaaaatcatcaaacaacttttatggaggtcgttatgtcaatagatcaatcttatgccaaactgaaactgtttgccctgaattcgaacctaccgttagccgaaaaaattgcgcagcgggtcggaattccactcggcaaaagttccgtaaagcggtttagtgatggtgaaattcagatcaacatcgaagaaagtattcgtggggcggaagttttcgtcattcaatctatttcggaaccggtcaatgatacaatattagaattattgatcatgatcgatgccttaagacgtgctagtgccagtcagattaacgtggttattccttattacgggtactcacgtcaagatcgcaaagcgcgttcacgtgagcccattactgcgaaattaattgcaacgttattggaaaaggaccgggccagtcgagtcttgacggtcgatttgcacgccgcacagattcaaggattctttgatattccggttgatcatttatttgcggccccactcttggcaagttattttaaagatcgcggcattaccgataatctcgtcgtcgtgtcaccagatcatgccggtgtttcgcgggcacgtaagatggcagaactattgggggccccaattgcgattattgataatcgacacccagatgatgatgacctagtgccaagtagtattattggtgatgtgaaagggcgcgtcgccattgtgatcgatgatatgattgatacgggaacccggttcgatgtctcggcagatgctttagcacaagcgggagcagcgaccgtatacggctgtgcgactcacgcaatcttttcacaggatgcagtggctaaattacaggcttccaagttcgagaaagtcatcgtgacggatacgattcagatcccagcggataaacaatttgataagttggtgcaactttcggttggtccattattgggtgatgcaatcaaattagtacatgaacagcaaccagttgatcggttgtttgatcctcgcatctagatcgcaactttaagaggctgtgacataagtctctagaaacaaaacaggtctggaaaaatcttcggatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtgccatgttaaaactggtccttttagcatactgctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgatctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttgaataaacgacgtgataaaatgcgtgaacaccaagcacagcaagcgatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaacattatgaaattggtcacggtagggaccaactttaaaaatcaaaggcgtaagcaaatgggacgagaaaccaaaattcggtttctcgtcccatttgcttatacagaggctagttatgtcacagcctctttttggttcgtttactgaatagcgtaactcgtccaaacagtgcaactaattacttgaagtaatcaaaagataacattccgtttatatgcataaacgttgctataacagccaaatgcgccgctttggcattggcaaacgttttttaaaataaccggactgttttgtaaaaaaacgagcgattctagtttgtattttggtaaattgtgctacaataaaattatgatttgtaaaagcaggttaagaatttcttaatcttcagtcacaagacgattttgttactgttaatttgagttcaaaaactaaggagtgaattaaatgtcacaagcacatacaacgggcaaggtcctagccagtacggttggtgccgttggtttattgcttgctacaggccaagctgccaatgctgcctcaatcactgtaaaagcaaacgatacagtttggggcctcgctcaacaacacggtgtttccgtgcagagtattgaaaaacttaaccagattaaagcatctgatggtaatatcgatttaatttatgttggtcaaaacttacaaattggtggatccgcaactaagaccgccacgactaagtcagcaactaagaaagccgctactaagggtacatataccgttaaagcgggtgacactctttgggcgcttgctgataagtacaacacttctgttcacgctctccagacgttaaatggtctttctggcgatttaattgtggtgggtcagaacattcaagtgccaggagcaacgaccaagacgaccgctaagacgagtcaaaaaacaaccatgtcagctactagtgcagcgtcaactacgagtacgactgccaaggccacgacggctgttagtgcgagttccacctcaagtacaagtgcgagttcggtttcaagtgtgagtgcaagcgttgtaagtagcaccagtgcagcaagtcaggatgctgtcagtgcgaactcagcaagcagtactagcacgtcaacgatattatcatcgaccggctctgttgcttcatcaacggctacgacctcaaatgcaccggtcaaagcagtcgcaacgagtgcagccgtatcagcaagtagtgctagttcttcgactgctaccagtcagtcgaagagtgttgcagcgagcgcctcagtaacgagtagcgcgtcctcatcagctgctagttcaacaacgactagtcaaagtaccgcttcaactgcgagtgcaactagtactagcagtacgactgctactagcacagctagtcaagcatcaagtacagctgctagtgcagcatcaactacgagtacagcgagccagagtagctcggcagcgactagttcaagcacgaccagtcagagtagttcttcagcagccactagcagtgcaagcaataccgcaacgactaatagtagcagtaccactactagttcaacgagtgatttagctactggttctgtaaccggccttgcgctgaagttggctagtgccaacatcccttatgtttggggtggtgcgagtctttcgggaatggattgttctggtttagtttcctatgtttaccaacatgcagctgggattaccttgccacatagtacggttgcacaggaatcttatgtgacgacgcattccgttgcggatgctcaacctggagatattttattctggggtagtcgtggtagcacttatcacgatgccatctatattggaaataatcaatacgttgcggctccaactgaaggccaaaacgttcaagttcagacaatcagttcttacttcatgccaagttttgcaggtacggttaagtaagccgattttaattgcaaatacccctaacacgatattgttaagtgttaggggtatttttatttaaatttttttgaattttatgatttaaacttaccaataattgtggtatattatgtttgtcgtttttcaattcgaaaaattggaccatctattgtgataaggaagtgctatcagtgagtaatcgttttgagattctggaagaatatcaagaggctaataccgaactcgatcatttaaggacgctagccgttcggcaacaggatcgctcacgggttgtgaccatttatccgcatttgaaagaacgggtgagtcacttatctcgtaaatgtgaacaacttgacatgcttctggaagcaatcaacgcttctgaggactaagattaatcaagactgactgtgtgaccatattgagatggtcagcagtcttttttattagccgagtgggtggggagtcaattaagtggttattagcattgctggccggtaagtggatggcgctcaagtagtatgaattgccaatcttggtcctataaaaaagtcgttgcgagcatcttcgcaacgactttttatcgctaatttgtattgttttagcagtagagttagtggtggtcatggatactagtgtcgatccagaatgggtagggatgggtggacaagtagaggtcgtaattacgattcccaataatttgaccatccatctgaccaatttcaacagagttaaccaacaagtgcaagttagcgttgcgataatggtgaacgaaacgcgacttaagatgacggccacccagtagcagtaagacgaacaaccagaggataatccaccagtgaggctcttcgacaacgatcaattcgagctgatcatcgtgcagattagcctgaggcagaattttaactccgccaccaaagtatggaatgttcgagactgtacaaaggaaagcccgcttataatagtctcgcttccggttaacgtgtacggttagcgggaagccttcctgttgggaatatgcggccagcatgttactgagataagcccaacgacccagacggcccttctttttgctacggtttgtgtcatcaacgatttgagcgtcaaatcctaaaccaacgttgttgacgaaataccggtgttcgtttttcaaggcttcatggaaataaccaacatttaacgaacggggccgcatattgttgagtacttgtgcaagtgcaattgctggatcagtcgccatacccagaccgcgagcaaagtcgttgcccgaacctccaggaatgtaggcgagcgggatcggttcagcttgtgggacctgcataataccattcaaggcctcgttcagtgtgccatcaccaccaatgaccagaatgaccggggttacgtttggtcgtcgttgaatggttttaacgtactcatttgcgagccgaattgtgtggccggcatattcagaaattcgatattcaaatcgaatctgtcgttgttctagaatcggcttgacggtttcccaaacgaccttaccgtgaccagatcctgccagttcattaataataatgtagtattcagcaatcaaaattacacctcatatcagtcttacaccataaaaaaccggaacgagatcgttccggcaagtagttagttcataatcaacattggcagaatcattgggtgccgttcagtcttatcaaataagaaactctgcaggtcgtcaataatcgcattgcggatagtcgcttcggttgctttatccgacttcattttgcgccggatcgtacggaagacatgccgccgggcttcgttaattagatcgccagactcgcgcatgtagacaaaaccacgtgacagaatatctggaccagcttggatctcttttttgttcaaattgatggtagcaacgacaacaaccaaaccttcttccgaaagcacttggcggtcgcgtaacacaacgttgccaatatcgccgattccagaaccatcaacatagacatcgccagcaccaaagtgaccggcaacccgggcagaatccttcgtaaaggcaagcacatcaccattttcaaggataaaactatggtctagtggcacaccacattgttcggccagttcggtgtgaatcttcaacattcgatattcaccgtgaatcggcataaagaactttggtttcatcagccgtagcatcagtttctgttcttcctgaccaccatgaccagatgtatgaatgttattgactttaccatgaatgacattcgcaccggcttcttcgagttcgttgattacgtggttaacacttaatgtattaccaggaatcggtgaacttgaaaagatcacggtgtcgccaggttcaatagaaatctggcgatgagtaccgttggcaattcgcgagagcgccgccattggttcaccttgggaaccagtacatagaatcatgactttattggcggggagggagcgtaaatcgttagcatcaacgatggcttcgtcagggatgtttaaatagcctaattcacgtccgttgacgatagctgcttccatactacgcccaaataccgcgattttacgatgatgttcaagggcgacctgcgctgcctcttgaatccgcgagatgttagaagcgaaggtagcaaagatgattcgaccttcaacttgttcaaaaatgtggcgaattgattgcgccacccaccgttcagatttcgtccagattggccgttcggcgttagtactgtctgacattagcgccaagacaccacgttcaccgagatgcgccatcttttgaaggttcggcggctggttagtaattggtgtcagatcgaacttatagtctccggtctctacaatcgtgccaggtggtgtttgaacggcgattcccagtgtatcaggaattgaatgggtcgttctgaagaacgagacacgcgtcttacggaacttgagcaccgtatcttcattgatctcgtgtaattcagttgtttttaataacccgtgttcctctaacttacccttaatcaaggctaaggctagggggccggcatagattggcacgttgatctgttttaataggaatggaatcccaccgatatgatcttcatgaccgtgcgtaatcactaaagcttttattttttgctgatttgcaactagataagaatagtctggaataacgtaatcaattccgagaagttcatcttcagggaatttaattccggcatcaatcagaataatctcatcttgaaattggataccataggtatttttcccaatttctcccaaaccgccgactgcaaaaacagcggtttcgttatttttgacgtttaaccgtttcatttattgaactccgttaggtgatactctggatttttttgttcgtaatccaagaagttaccttctaacggttcgataaattcgatgttgtgatctgtattatcttccactaaggtccgtgccgctacttcggtctcggcttcgagatacaaagattgggtcgtttcccgttgtgggttccgttctttggtttcttggtaatatactttgtaaatcatgtgtaaaactccttaatataaacaagatttatttagatactaagtaatctaaatagatagcaaaaataaaagtttgatccgtacaccaggttgtgtaaacacaacaattatcttacattttagcataatttgagatgggtgtatacaatgttaactttcttcaaaaatagagcggttaaaagaattttttttgatgaaacatgctatgctaaacataagtaataaaatgaaaaattcctaaaattgtgaatcattatacaaaaaaagaattgagggttgagcatgcagagttggttaacaatcattggtggggtactaatggcaatcgtcgtttatgaattgctgcgacggcaagtgctgaagcgtgcagcgttgaagattcggcgggctggccaacgaacggttgatagtgcgatggtagcagcattcaaagtgctcgcaaatgcgatgacgattcaagaggttgcgggggcgattcattcggtgcccgtcgcagacgtctgggggcgtggtgtgatggcctttgagtacgtgctagatgcaccaggcatggtcacggccgatttgccagaagttcggcgattattcaataacgaattgcaagcgtacgcaattcacaatcaggtggttgctttccgggaagctggaccagcgttacgagtgactgatgcgtggctgcgcagcggacagctccacttagatattgcctatttgatgaatgaggccactttagagtatttggaagatttgcgtcggttgaattcgagtgcaccaaaaaagcagtcctgaacatttcaggactgcttttttaaatgactttaagaaattagaactaaatcatcatcagcggcaaatggattgtcgccattgatatggtcgtagaataaaataccatgaagatggtcaatttcatgttgacaaacaatggccggataattcttgagacgaatctttttctcttcaccagccatattatagtagcgtaacgtaatccgatcgtgtcgaataacgtagccagcaatatcacggtcgacggataagcaaccttcaccttcagttaaggcgccgggttggacggagtgactgatgatcacggggttgataatgacgtctttaaagaccggttcatcatcttcattttcactcggaacaaggacagcagccatctgttccgaaacgtcgacttgcggtgcagctaaaccaacaccggcacgcagtccgtattttttagccaattcgggatcctggctgttttctaagtattccatcatgtcattggccaacttctgatcagcttcactcaacggaaatttaacttgctttgcttccgcgcgtaacgtgtgattaccttcgcggataatgtcgcgcattttaatcaattccaattacctccaaaattaagatcgcgcagtttacacttaatatctagtttatcataagcctacgccaaaaagtagcgcccgttatgaaaaagatgaaaacagaattaagcacaaattaaatagttcacaatcatttggacagaaaaagccggcttttcgctctttggaagggcttgcaaaagatgaaacgcaatggtaaattagacttgtaattatgaaaacgattacgaacgcggtgcgatgcacaacgtttgtacgttcatgaaagggatgtgtcatttatggacaacgaaaaaccaattgttgattttggtgcgatccgcgatgcacttgggaaagactttgagcccgtgcaagtattggatggtcaagctaaagtaattaaaccagaaattgtctctaaatattcaaacgaacaactcgttgaattctttaaattaatgttatgggaacggacgttacatcaacgttctaacgctttgacacggcaaggacgcttaggattctatgcgccgactgagggccaagaagccagtgagatggggagtaacgccgcgatgaagaaaaccgacgttttaatgcctgcttaccgtgatattccacaattgattcaacacggactacctgtttataaagcgttcctatggtctcgtggtcatgtcttgggtaacgaatatccagaagacttccatgcaatgccaccacagattattatcggcgctcaatacgtacaagctgccggtgtggccttaggaattaaaaagaacggtaccgaagacaaagttgcctacacttatactggtgatggtgggacttctcaaggtgacttctatgaaggtatgaactttgccggagccttcgaagcaccggccgtcttcattgttcaaaacaatggttatgccatttcagtaccacggcgcaagcaaacagctgcgaagacgttggctcaaaaagcagttgctgccggtattccaagtgttcaggtcgatgggatggacttcctagctgtttatgaagtaacaaaggccgcccgggaatacgctgctgctggcaacggtcctgtcatgattgaaacgctgacataccggtttggcccacatacgaatgctggggatgatcctaagcgttaccggactaaggacgaagaacagccttggttcgataatgatccattgattcgttaccgtaagtacttgactgatcaaggtgtttggtcagaagatcaagaaaacgaatacgttgaacaagttaaagaagatatcaaggctgctgttaaacaagcagatgaagcaccaaagcaaaaaatgaccgaattcttggggaatgtttttgaggaacaaccacaaaacattcaacaacaaattacggaattccaagcaaaggagtcgaagtaacatgtcaaagaaaacgtatattcaagcgatcaccgatgcacttcgattagaactcgggtcagacgaaaagaccttagtttttggtgaagatgttggtaaaaacggtggggtctttcgggcaaccgatggcctgcaagccgaatttggtgaagatcgtgtttttgacactcctttagcagaatccggtattggcggtttatcaattgggctggcattggaaggtttccggccaatccctgaaattcaatttcttggattcatttttgaaactttggattcagttgctggtcaaatgtcacgggaacgtttccggacaggtggcacgcggcatatgccgattaccattcgttcaccatatggtggtggaacgcatacaccggaaatgcacgcggactcattagaaggctatttagctcaaattcctggtttgcgggtcgtgacgccatctaatccttacgatgccaaggggctattaatttcttctattcggaataacgatccagttttcttccttgaaaacttgaagttataccggtcaatgaaggcggatattccggatgaagcttataccgttccgttagataaggcaaacgtggttcgtgaaggtactgatatttccttgattgcttacagtgcacaagttaaccagtcactgaaggttgcggaaaagctcgaaaaagaaggaatctccgttgaagttgttgacttacggaccttgtcacctttagatgaagaaacaattctcaagtctgttcaaaagactggtcgggccgttgcgattcaagaagcacaacgacaggctgggattgctgcgaacgttgcttcactgattgctgaaaaaggtgcgctttatctcagtgccccagttggccgggtgtacgcaccagatacggtctacccattcggattagcagaagacgattggttaccagctgaagatgaaattgaggcaaaaacccgcgaaatcttgaactattaatcaagacgcggcatcgaaaaacagtcacctgagactgtcatgaaaggaagttatccaatggcttacgagtttaaattaccagagcttggtgaaggtcttgaagaaggcgaaattgcatcatggctcgtaaaacctggtgatgaagtcaaagaagacgattctctagttgaaattcaaaatgataaatcggtggaagaattaccatcgccagtaagtggtaaagttattgatattttagttccagaaggtgaaacggctaaaattggtgatgtgatcgtcacgattgacgatggttctggcgacgctgcgccagcggctaaggctgaaacaccagcggctactaagacggaagccccggcaagtgaagcagctgaaactcccgctgcaacatcagcacaaccgactggaaccccggctgcgggcaatcctaataaacgggtcttggcaatgccatcagtgcgccagtacgcacgtgataaggacattgacatcacgttagttacgccaactggtgcccatggtcagatcacaaagcaagatattgacaattacacgggtgcgccagcggcaacgggtgctaaaccagcagctacgccagcgacaacggctccggctgcaagtgaagcaccagcaccaacaccagttaaaccatatgtttctgacacacctgaattagagacgcgtgaaaagatgacgccaattcggaaggcaatctctaaggctatggtgaacagtaaacacaccgcgccacatgttactttatttgatgaagttgaagtgagtgcgttgatggcacaccggaagaagtacaagcaagttgctttggatcgcgacatccatcttaccttcttaccatacttcgtgaaagctttggttgcggttttacaacaattcccagaattgaacgcgtcgatcgatgatgcaaacaaggaaattgtttacaaacactacttcaatattggggtagctaccgatactgaccgtggattgttagtgccaaatattaagcacgctgaaggtaagggcttgtttgcaattgccaaagaaattactgacaatacgcaaaaagcttacgatggcaagttaaaggccagtgaaatgagcggtgggtctattactattagtaatattggctcaattggcggcggctggtttaccccagttatcaaccaaccggaagttgccattttaggtgttgggcgtatcggtaaggaaccttacgtcaatgacgatggtgaaatcgttgttggtaagatgcagaagttgtccttgagttttgatcaccgtctgattgatggtgcaacggcccaacgggcaatgaacttattgaagcaattgttacatgatccagaattacttttgatggaaggatgaggtcagaatggttgtaggagattttgctgaagaacgcgatacaatgatcatcggcgcgggccctgggggttacgtcgctgcgattcgggccgcggaactcggccaaaaagtcaccgtggtggaaaaggaatatatcggtggtgtctgccttaacgttggctgtattccatcaaaagccttgatcagtgctggtcatcgtctacaagaagccaaggacagtaagatctttggtattaaaaatattcaggatccggtgttagattttaaggtgacccaggactggaaagaccatcaagttgttgatcggttgactggtggcgttgaaatgctgctcaagaagcataaggtggaagtggtccgtggggaagcctatatgcatgataatcataccttacgggtgatgaatggcgaccatactggtcagacttataaattcaaacatttgatcatcgcaactggttcacggccagttgaaattccgggcttcaagtttagtggtcgggtcgttgactcgacgggtggcttgaatttgcctgaagtgcctaaagaattagtggttatcggtggtgggtacatcggttctgagttagctggtgcctatgccaacctcggtgctcacgtgacgattcttgaagggacaccgcaaatcttacctaacttcgaaaaagatatggtcaagcttgtcttgaacagctttaagaagaagggggttgatgtcattactaatgcgatggctaaaaactccgaacaagatgatagtggtgttacggttacctacgctgtcgacgggaaagaaactgagattcatgctgactatgttatggtcacagttggtcggcggcctaatactgacgacatgggcttggaatacactgacgtcaagctaacgaagcgcggcttgatcgaagttgatgaacaggggcggacggccgctgaggatatcttcgcaatcggagatattgtcgccggtgctgcgctggcacacaaagcttttgctgaagccaaagttgctgctggtgcaatcagtggcaagaagacggcgaacgactacgtttcaattccggcagtttgctttactgatccagaattggcaacagttggcatgacgaaggctgaagctgaagaagccggcttgcaggtgaagacgtcgaagttcccatttgctggtaatggtcgtgcaatctcgttgaacgccatggacggcttcttccgtcttgtcagtacgaaggacgaaggcaccattgtcggcgcccaaattgccggaccaggtgccagtgatttgatttctgaattaagcgttgcggtcaatggtgggatgaatgtcgaagaccttgctttgacgattcatccacacccgaccctaggtgaagtagttcaagaagcggcggatgaagcggtgggttacccaacgcacatctaaagcggatgatggcttaataaaagtttgaggcgtgagtctcaaacttttattttacataggatgttgcagccagtagggattaccgaagtaccagtcaagatagtcacgtaaaaacgtaacttaaacggcactgtcaggcgcaatgaaggtcagtcttgtgaatcattactcagctgatccgtaagtgacgcctttgaacctgacgtggatgttgttattcaaattgctaactttttagcatgtagtggtctatattaataacatatcaaaatgtgtttgcttcgggggaaagtggaccaattggttacgcaaaaatgttacaaaagagtaagctttttattaacatttacttgaattcattgacagctcaggtacaattattatcgaaggttggagggattgaaatgattaatacagtaattattcggggattattcgagttcgtacaacaattaatattagtcgcaattgccaaagatttgccagtgaaattagtggtcgcaacgggtgctgaagaagcgccgcgctaccaagcactggtaacagcgagtttaacttgtcgtcagtttacactagtggcgcaagctaagccggattattcgcaagcagatagcttgattattggaaatttagtgccattggcaagcgaccgtgatgccagtggtgatttaaaggcgactttgccgctatttcgcgcgtttgtgaatgatgcgatgggcgctggttttaacggaaaaattattttggctggtagcaatgatgcggttttaagtgtcttagctgcgcgtttcagtggcattgatcattctaaagtggtcggattgggtactttgccgcagagtcgtttattggaacaactactacgtcagcaattaagtgtcggcccggcggatgtccgcgcattcgtagtgggaactgcggcgacacacctgatctcatggagtcgttcatatattgggccggcgcccgtgatgacttatttggctaaccaggatattagttttgggatggacgaaatgagtgcagcgacggagcagatcgacgaccccacgattgttactaatcagaccttgagtgtgttagcattagtacaagtgctcaatgcgttttacgcccagacaccgtttatcggtaccgtcacaaatatccaaacaccagtcgatgacgaccagctggttggattatcatcaccggtactgattagtgctaacggaatcaaacgaatggcggatatggtgctatctgatgaagagcagaaagaatacgctgagattgcgagccaggttcaagaggaacttgaccgggtcacggcgggggagttggatgaagatgcctaaacacaatgataattaccaatatccactggatgagacgtggaccacggccgagatcattaaggttacgaccttttatcaagccatcgaggccgctaatgaaggaacaatcgctacagcagacttgttggcagcctatcgtgattttaagacggtcgttccggctaagtcggaagaaaaacgactggctcgtgattatgaggctgcttcaggttatcggatttatcaaacaatgcgcgcagctcaggaaactaacaagcagcgatttcaataccgagactaggtgacttaacgtgcaaacgaatgtggtgaaacagttaaatcagaaaatgcaagtcgtgatgcaaactgcgagagcgcaagtgttggcgaagatgggcacccacttgacggttgcggagaagacgagtcggcgtgatttggtcactaacgtggatcatagcaatgaagattttttggtgcgtcagattcgagccttggatccagttgcgaagattttagctgaggaaggaaccggcgaccaagttactgatatgaatggtcacgtctggatcgttgacccaatcgacggtaccatgaattttgtgcatcagcgtaatcattttgcgatgatggtgggcttgtatgttgacggtaaaccaacactgggatatatctttgatgtcatggcgaataaattatatgctggtggtcctgaagtcggcgtcacgcttaacggtgaattgctggctgcacccgcggatgttgatctgagtgcggggctgtttggtgcgagtgcgccgttactaattcaagaccgcttcaatatgcagacgattattgccaaatcactgggaccacggattatgggtagtgctggtattcaaattagccaggccttagcgggcgaactggtcggctacctgtcatacttgcgaccatgggattttgcggctggtcgcgttctcgcggaaagccttggcttagttgtgtctagagttgacggcaacccggttaatatgttatcatcgggtgctgtactgatagcgacaaagcgcgcacaacgctcaattttggcaatcgtctagtaagtagtgggactgtgacccatatgtcacagtttttttatgtcaatggatgaaagccgctgaaaacgtcgttatgaaggcttcaagttgaagctatgacttgatagtaacggcggattgtattaatatatgtaagatttctgctgtcgaagatagtcagaattttgaaggatgaaaggaagatcaattttgaaatttagagatgatatccgcaacattgccattattgcccacgttgaccacggtaaaacgacgttggttaacgaaatgcttaaacaatcggatacccttgacgaacatgtccagattgacgatcgggcgatggacactaatgccattgaaaaggaacgcggtatcacgatcctttcgaaaaacacggccgtacgttacggcgacaaacaaattaacattctagatacaccaggacatgctgacttcggtggtgaagtcgaacgaatcatgcgcatggttgacggggtattactcgttgttgatgcgtttgaaggaacgatgcctcaaactcggtttgttttgaaaaaagctttggaacaacacctaacaccaatcgttgttattaacaaaatcgaccgccccggtgcacgtcctgaagaggtcgttgacgaagtgttagacctcttcatcgaattaggtgctgacgaatcacaattagacttcccagtggtctatgtttcagctttaaatgggacttctagttatgaatcagatcctgctaagcaggaacatacgatgcaaccaatcttcgatacgatcatcaagacgattccatcaccaattgacaactctgacgaacctttacaattccaagtggccttattagactacaacgattatgttggtcgggttggtatcggtcgggtcttccgtggtacgatcaaggttggtgacagtgtttctgtcatgaaacttgatggtagtaagaagaatttccgcgtaactaagttgtttgggttctttggtcttcaacgtttggaaatcaatgaagcccacgccggtgacttagttgctgtttctgggatggaagatatcaacgttggtgaaacggttgctgattcagctaatcctgaagctttgccaatcttacggattgacgaaccaactttacaaatgactttcggtacgaactcctcaccatttgcgggtaaggaaggtaagttcgtaactgcccgtcaacttgaaatgcggttgaaggctgaacttgaaaccgatgtttcacttcgggttgatgatactgacgaacctggttcatgggttgtttctggtcgtggggaattgcatttgtcaatcttaatcgaaacgttacggcgtgaaggttatgaactacaagcatctcgtccagaagttatctatcgcgaaattgatggtaagcgttgcgaaccatttgaatctgttcaaatcgatacgccagacgaatatactggttcaattattgataccttatcaaagcgtaaggctgaaatgaagaacatggaaagtactggtaataaccaaacccggttgactttcttagcaccttcacgaggcttgatcggttattcaactgaattcctttcattgacacgtggttacggaatcatgaaccatactttctctgaatacctcccagttattcctaactggaacccaggccgtcgtaacggtgctttggtttcaatcaaccagggtaagaccacgacatacgccacaatgggaatcgaagaccggggaacgatttttgttgatccaggtaccgaagtatatgaaggcatgatcgtgggccaaaatagccgcgaaaatgacatttcagttaacattactaagggtaagaacatgaccaacgtgcgttcttctaacaaggatttgacggcgacaatcaagacaccaacgcatttgacattggaagaatcgcttgaattcttgaatagtgatgaattctgtgaaattacgccagatcatgttcgcttgcggaaacgcattttgaacacgaactcccgtgaaaaagaagctaaaaagcgtaaaatgaacaagtaagttgattgcttggaagcacgtccttaatagggcgtgcttttttggtactggcatgcctaaggctgtatccgccaaagcggtttgaagaggagtcgtttaatcaccaactcaaatattgtcccattaatggttattgggttcatttagatggaaataatgattgataaattgttatccagagtatagtattagtttatagggtaaaaagagtctaatggtcttcgttacccgttaaaatggtattgaacttgggaggtgtgatcatcgtgaaaaaaattaataagttgatgatcttaggcatgctcgtttttggggtaacgggggcaacaatgatcaatcctgaaatgacgaccgcagcgcatgctagcgccaacatcaccattgatggcaagatgaacgactggaaagatgcgacgttaacggagggctataatggttacacggcactcacgagtgctggccagtatgtcaatgtttacgtcaagatgaaaaatggtgctgtgccaggatatggcgactataatttcactattgatggtaagacgtattatatttggtctaagaatatttcaggtagtgttagctcgggaacggtcaagtccttcacattaactggtggtaaatggaacgatggtactcagtatggaactgtcgggacgggatatgtgaccaacgacggttcgcataattatgccgaatttcagattgacttaaccaagttaggattaactgacagtgcgagtggtaagcagatttcgatggtcaatccgaatatcggtagtgactctacgactagcactgttggaacaattatgtcgacttcaactagctcaagtagtagtaccagttcaagtacaaatgcgaattctacaactagttcaagttctacgactagcaccagtagtgcagccagttcctcagcaactagctcagctggggtaattactgataaaagcacggtctcttccaaggcgtcctcgacgacggacaataatgcagccaatgacaatgataatctcaacattaaaatcgatggtaactttaatgattggaagaacgtgactttgaccgagggttataacggttatatggcaatggttagtgacgggaagtacgtctacgtttatgtcaagatgaagtatggacaggttcccggttacggggattataatttcgacattggtggtcagaagtattacgtgtggtccaatgagatgcctagctcgcaaagtgacggggcggtcaaagctgtctcatttacgggtggtaagtacaatgagggccatcagtacgggacggtcggcaacgggtatgtttctcaagccggttcacattcgattgctgaattccgagtggacttgagcaagttcgatatttcaacgatgaccggccaaacgattacgatgtccaatccgaatatcggtaatcaaaaaatgaccgtggccgggggctcaactggtccgtacgtaatttccggtgtcggtgtcgtaatcgttgcttggggatactttaaattccgcaagcggcgtcgattaactgcaacggatttaccgaccactaagaactgatgattgataacatgttgtgctcgttattatttagcattaaccacgattaaaacgtgccgttcctttaaattcagaagcagccagcttaaacccgctggaaatagatacgagttggtgtaaacttgttttgctggttcgtcctaagccgacttccaggcatttctgccaattgctggaacgcggtggacacagatttaagccgcaacccacgtcttaaatactggtcttccactaaccaagccaaggacgcttgctaagtggaatttcaccgctgagcattggccgaaacgccttccagtcgggacagtgttcgaatggcggacatgtgcgtacccaacttttggtgaattcgtcattgtttttcataaaccataattttgtcaatcaactgtcagactgaaaatgatattgagatagctcactaatcctaaattgttgtagtgagatttaatctcttgacggagtgcttaatacacctaacgctttgtttaaaattccagtatcaaaatagtcaacgacaaattgtaccgagttcgatggtcgttcattagccattcgagcggcttcccgaccggaggggctgggtgacaatgctcagtagccaaattattcttagtcggaagtgtctttcttccggcttagaataagactcgtatttgagatgacgcgggttatgcgttagctcaaatcgacgtcggctgcgttccagcaattggcacccagccccggaggtcggcataggacgcgcaccggctgacgaacaggaatctaaaattggcacgttttaatcatgattaaagatagattaacttgcacgatgtgaattgaatcgataactattgaactaatgatatttaatttactgacaatcaatttataaccactggcggcttaggcgcgtcggtaagctaattaataggactgatgtacgatgaatgtaaagatcctactagggattgtgatatggttatacggactgtcagtgctcaaacgggctcggctatctgccttctacttcattgtgggaagcgccgggctcttttttatcttgacggcaattagtcgtccgtattgggtgtggttttttacccacgctgtgattcatggggtagcgctgtttagtgatattaccggttggtgcagtattatgttcaaaatgggcctggtctacattattaatagtggtaatccggtaatcatgtcgattgattatgaatgctcgggaatcattgagacgtgcgcatttatttcgctagtagccttttacccggcttaccagcgccgtgaaaaggtgttttatggtgtttttggattgttgtatatttacttgattaatgtattacgcctgtccgtagtgattgtgattgttcactttggcggtggtcaaacattctttctggctcattcagtgattgggcggttactgttctatgttctggtcattgtcttatattacaatgtttttacctattcacagttagctcgaggactttatcagcagtttattgattggagggagcgaatcctgtgatgtactggataaacttagcgctgactagaatggggttttggattacctgggccttagtgccgatcgtggtggaaattattccggcaattatgtcgactattaagttaatgcgactacatcgccacatgccccggcttaaagcgcctgctaagtggccgtgggtaaccatcattgtaccggtttataattctgaagatacgttatttgactgcattcgttccatcgatcatcaaacgtatgataaaaaaagcatgcaaattattttggcgaataatcagagtaccgatgatagttttggggcgtatgcccgcgcccaaaatgcgtttcctaatttatttttacggtatgtcaatactgacaaggggaaagctcgcgcgcttaacgcggccatttacgagagtattggtagttatgtcattaatattgatagtgatggtttattggaacccaacgcgattaaaaatatggtactacgattcgagaacgatgagcagattgcggccatgaccggggcagtgctcccacaaagaaacttggttaagcaagttcatggttggtggcatcggctgttggctaaaaatgagtattacgaatatgcacaggcttttctttctggccgtaccatcgagtcgttccgtgaccagctgtttaccatgtcaggagctttctcggcatttcgacgggaagtgttaatggaaactttcttgtatgacaccgatacaatcggtgaggacacggacatgacgtttcagattcggacacgtttaggcaaaaaggtcgttatttgtgcggatgctattttttatgtggcgccaatttcaggcttttccgagttatatacgcaacgccagcgctggcaacgtggtgaactggaagttgcacaacattatatgtcacaaacagctagcatcaagggctttttcaaagaatttttggtgcggcgaattatgattgatcacacgtttacgtttccacgaatgatttggacttttgcgacgattgttttgattgcttttggctattcaactgtggtcgtggggctctcatatctcttgatctatagtttatacgtcatggtaggggttattaactttattagtgttggtattttattaaagccgtatcctgaagaacgccatttctacaagcatttatggtggctaacattaacgctgccactttatatgtttttgacagcttggattcgattgattggtgttatcaatgcgatgacgacccaggcaacttggaaaatgcgggggttcaccgaagaatggcaacggttgttggccgtcttacgtgatgataggcgtacaatccacaatcactatcgacgccggaaaggaaaatgagttgaagcggcacgtgttggctgactacaagatatcacgcgaagttagcggaatatcttgattgtttagttcaggtgcaagaattcaaacaaagtagattaatgatgagacgttatttttatcaatttagtcagaagatgattacgagcgtttggtggttactatttgcaccaatgttgttatttgcagtaatgtcgccgaatattattttaggggataacgcgacgtttgggacgagtacgaccttattgacgacggggttgattattgtgattgtcgccgtgttgattatgaactatgcgtatccgcgcgttcatcgggtgctatatcgactactaatcacaaatcagctccggacggctggtgtcttgttagcacttgtttttattggtcagctcgtattcgtgacatttgtccatcccgtcagtggttttgacgctgggatgctccactatgcggctaccagtgcgaaacacgtccaggaggtgggcgtgacggcgtattacagtcttaatcaaaacaacatgccaatcatgctttttatgcactggctatcggaagtgactggtcaaacttcatggcaattttttgattacgtgacgctgttttttgtcgatctttcagcagctttcaatttaatgagcgtatttgtggtacgacgctcggcgttaggaatcgctatgtatctgcacgccggttggttagcggtttttccaagtattattatgccgtatacggatgcttggggactgccgctggtttcgtttttcatgctgtgctattttgtgatgagtcaaacgaagcgaccgccgttactgcgtgtggccgccgccgttgggtttggtgtgagcgtgacattaacgtacttcatgaaaccgtcatccattattccggtaatcgccattgccatcatcagctttttagcacgtttgcggtcgcggcagggttcacaaacgacgatgatttttgtgacggtcgccatggcaatcttgatgctcgaaagtgccggcctcacttatcattatacgaatcaggccatccagaaccagacgtatatcaaaatcgataaatcaaggtcgattccggcgattcactttatggccatgggcgtttacggctccggcgggtatagtgaaaagcaggcgatacagatggccgttttgcccaccaaggcacaaaaaacggcttactcaatcaagatgctgaagcgtcagctcaagaaactgggaccgtggggttaccttgaattcttggtaaaaaagcaacgcaataatactgctgacgggacctttggctggttgaaggaaggcaatttctttcgcgaaaatcaaaaaccaagcaaccagggctttagtaattggttaaaaaactttatttatttatacggtcgccatattgcagattttcggtttgtggcgcaactgtggtggttagtactactcgtaattatcgcgttgggttttggcccgcgctggcaattgattcaattgctccggttggcgatgattggtgggtttatcttcctcctcttgttcgaaggtggtcggagtcggtacttaattcagtacttaccgtgcctgctattactgggagcattctcatttgaacgggcagttgcgaatatccagcgtattagggattggtatcagcgtaagttgcgagccgcgattgcggcagatgaggccgagtgagcgtgcaatcgtcccagtgcgtgacacgaaattgatcgttaacgagcggttagcaatccaaaatagctgtggtgggtcctaaatggggcttaccacggctattttatcgttcacgttgtcgattgttggctcttgcgggggcgcttatcgcgttatggttggcaatgcgcgataaattcattccgacgtcaagtgccggaacggcgcgggttgttcaaatcgtctaggtacgtttattaagggaaatacactgatttggaggcgttggccagccggttactaatgaggctaaacgcactagtttgtaaatcagtaatccaaacttgattaaaaaacaacaaattaatatgtgaaaatgctgtgttaaaatcgacttatgctataattgttgcaagcaaacagttcgcgttattgtgggggataatccgaattgagatattaattagggtgggatttaagctcatgtggaaaaagttacactatatggactatgtgctgtttatcccgtatttgattctcagcgggatcggcgttgtcatggtctattcatcgagttcatacgtagccgcacaaaacggttcgacacccaccggttatttagttaaacaactgatctgggtcgtcttaggcttagtgatcaccttggtttgtatgaatttgaagatcgactattttaagcaaaccaagttacttggtatgttagggtttgcgatgttatttgttctggttctcctccgattggttggtcaatcaattaatggggcggctggctggatcattttgggaccagtctcgatccaaccagctgaattttgcaagttttacctgatcatttacttggcatcaattatttctcaacgggaggcacattttggggtggctcgaatccgtgaattgggtgctcagtttgtgatgttgttcgcgatgattttactgatttttgtgcaacccgaccttggtggggccacgattaatttagccatcgcggcggttattttgtttgcgagtggcatttcatactttgtaggtgttggtgtctttgctggggcggtcgcggcctttgaatggattttagtacctttagtgagtcgcatgccccaaagtgcttttgcaaattcttatcagttacggcggtttctcggtttcctgaatccgtttaaaacggcttcaggagcggggacgcagttagtcaactcttactatgccatctcaaacggtggtttgacaggcgttgggattgggaatagtttgcaaaaacgtggttatttacccgaaccgaacactgattttattatgtcaatcactgccgaagaactcggactaattggcattttaatcgtaatgggcttactacttgtcatcgtgatgcgcacgatctatatcggggttcgtgcgactaatacgttcaacgcgttggtctgttacggtgtcgcagcctacatgaccattcaagcatttattaatgtgggtgggatcgttggtctgattccgattactggggtgaccttcccattcatgagttatggtggttctagcatgatggtattgacgctttcactaggattggtattaaacattagtgcacttgaaaaaatggcgcgccttaatacagttcgacaggcaggctaagacgattttatttggaaatgagggattttggtgaagaaagtattaattgctaaccgtggtgaaattgcgacccgggtcattcgtgcttgccacgaattaggccttcagactgttgcgatttacgccaaagaagatgagttttcagttcaccgttttaaagctgatgaagcgtacttagtaggtgagggtaaggcgccgattgcggcttacctggatattgaagatattattcgcattgctaaagaaaatcatgtggatgcgattcacccaggttacggctttttatctgaaaatgctacttttgctcggcggattgctgaagaaggcatgaccttcgttggtcctaagccagagcacctcgagatgtttggtgataagattacggccaaacgtgtggctcgcgatgccggcgtgcagacgattccgagtaccttgcacccggttactagcctgaacgaggcgttacaatttactcagcaatacggttatccaattatgatcaaagctgccatgggtggtggcggtcggggaatgcgcatcgttcacgaagcttctgaattacaagaagcttttgaccgtgcccgttcagaggccatgcaatcctttggcgatgacgagatttacttggaaaaattcatcgcgaatcccaaacacattgaagtccagattttagcggatgctcacggcaatgtcatgcatttatttgaacgtgactgttctgttcagcgccgtaatcaaaaagtgattgaatttgcaccggccgtggccctgccaatcgagttgcgtcaaaagatctgtaacgccgcagtcgacttgatgaagagtgtacactatttaaacgccgcaacggttgaattcttggttgaaggggaccaattctacttcatggaagttaatccgcgggttcaagttgaacatacggtgacagaaatgattactgaaatcgatattgtccatgctcagctcaaaattgcgatgggtggtgacctattcgaggatttacggttaccacatcaagacgcattgacatataagggtgcggcaattcagtgtcgaattacgacggaagatcccgcaaatgattttatgccagatactggtcgcatcgagacgtaccggtcaccaggtggtaatggggttcgtttggatgctggtaatacctattccggcgcaatcgtaacaccttattttgattcactgcttgtaaaggcttgtgttgcggcgcggaacttcaaagcggccgttcataaaatgcgacgcgtcctagttgaattcgatattcgcggcgtgaagacgaacattccgtttatgctgaatgtgattgacaacccaacgttccaagcaggtgaagcggggacccggtttattgatcagaccccaacgctcttcaaattccctgacgatacgcaacgtgaagataagatgttgaagtatattgggaatgtgacggtcaatggtttcgctgacgttgcccaacattcgaagaagtactatccggacgttgagtttaaggatgattttcaaccaatcgcacccgacatcgtcacggcaaaagacgtgttggatcaacaaggtgtccagggattacaacagtggttgttagcccagaagcaagtgttattaacagatacgaccatgcgggatgcgcatcagagtttatttgcaacgcggatgcggacgaaggatatgttagccgttgccgcggcttcacaaaaagcgttgccacagttattctcctatgagatgtggggtggtgcgacgttcgatgtggcctatcgttttctaaatgaaaatccctggaatcggctgaaagaacttcggcaggcaatgccccggacactcttccaaatgctgttccgtggttccaatgcggtgggttaccagaactatccagataatgtgattcgcgaatttatcttagaagcagctaagagtggcattgatgttttccgtatttttgacagtttgaattggattcctcaaatggaaaagagtattcaggccgtcaaggaaactgggaagattgcggaagccacgatttgttatacgggcgacattatggaccctgatcggcaaaaatacaatcttgattattatcgtcagctggccttggatctgcaatcaactggtgccgacattattgccatcaaggatatggcgggtgtgttaaagccagaggccgcctatgaattagtatcgacattgaaagacgcactgtccgtgccagttcatctgcatacgcatgatacgactggtaatggaatctttacctatgcccgagcagtggaagctggtgttgacgtggtcgatgttgctgcgagtgcgctatcaggcacgaccagccaaccatcaatgagttcgttgtattacgcattagcccacaatgatcgtcaacctgatgttgatattaacaacgttgaagccatcaatcggtattggcaaggcgtacggccatactaccaagacttctcgaacggtatgaccggaccacagacagatatttatcagacgcagatgccgggtggacaatattctaacttgcagcaacaagctaaggctgttggtcttggggatcgttgggaagaagttaagacgatgtatgcgacggtcaatgatatgtttggtgatattatcaaagttacgcccagctctaaagttgttggtgacatggccctgttcatgatggaaaatcacttgacaccggacgatgtttataatcagggtaccaagctcgatttcccagcatcggtcatcaacttctttgctggcaatcttggtcaaccagtcggaggctttccaaagaagctccagcagattgtcttgaaaggccagccagcgttgactgtgcggcccggtagtttagccaaaccagctgactttgctgcggtcaaagcagagctatcggctaaacttggtcatgaagcgagccatcaggaagtgctcagctacatcctgtacccgaaagtattcatggattacgacgctagccataagcgttacgggcacgtatcactgttagacacaccgacctttttccaaggcatgcggctcggtgagacggtcaatattgagttagccaaaggtaagacgatgatcgtcaagcttaatcagattagtgatcccgatgtcgatggtgtccggacactttactttagtatcaatggtcaaaatcaagagattatggtcaaggacaatgccattcaccaatcggcaaccagcacgcgcaaggcggaaccaactaatgaagatgaagttggcgcaacgatgagtggttcagttctgaaactgttagttaagaagggccaaacggttaagaagggtgagccattacttgtgacggaagcaatgaagatggagacaaccattcaggcaccggaagatggggtcatcgaacatatttatgttaatgcgggtgacgtcattcagacggatgacttgctgctcgagattgcaccacaataaggatatttcaagcaaaaacactagtggcttaggttactagtgttttttagcttcagcgcttcgccaataaaaaccactgcgtagttaagaacttagttgacgaaatgctgaatctagcctaacatttaaacagcaacgctagtagaagaggtgaggttcgatggattttacagttaaaccgcgccggtcgctcatcgtttatatgcattcgatgaagcaggtgcgtcaattgaaacgttttggattaattcaataccaatcgcgtaaagagcattatgtggtcttgtacatggatgaaagtcaaattccggccgcgaccacgaaaatcaaaaaattaaattttgtccgcagggttgaaccgtcataccgcccggacattgcaatgaactttggcgaacgtgtggatcaaggcttttttaagccaaccacgactggtgcgcctgatgacgatgatgaggattaagttggtgaagatgaaatgcgaattgtagcaggagactttggtggtcgacggctcaaagccgtgccaggcatgcaaactcggccgacgacggacaaagttaaagaagctgtttttaatattattggcccctatttcgatggtgggcagtccctagacttatttgctgggagcggtggcttgagtatcgaagctgtatcacgcggagtggctcgggccgtcttgattgatcggcagtatcaagccatcaagacgattaaggataacattgccgttacaaaagcccccgaacgatttgaagttatcaaaggcgatgctgagcgtattttggaccgattagcatcccaagatgaatactttgattgggtgtttttagacccaccctatgccaagcaacagattgtgaaggatattcagcattgtgatgcactaggattgctgaatccgggttgtcgaatcatttgtgagacggatacgaatgcgaacttgccaacggtcttacccggatttgagttgatcagacaacaagattacggtattacggtcattaccatttaccaaaaagtaacggaggtcgggtaagttatggtgacagcagtttttccggggagtttcgacccaatcacacggggccacttggatatgattcaacgtgccagtcgattagttgaccggttgattgtggccgtcatggtcaatacgagtaagcaaccgttatttacgatgacggaaaaagtcgcgatgatcagtgatgagctgacggatttacccaacgttgaagttcaggccgcaactggtttgaccgttgactttatggcgagtgtccatgcgacagttttggtacgaggtttgcggaatgaacaggacttcggatatgaacgtgatatcgcttggatgaacaagtcattagacgagacaatcgaaacgatttgcttgattgcacggcccccgtacgcttacttttcttccagcttaattaaggaagttgccaagatgggagcggacgtttccaagtacgtcccgaccgcggtggcgcaaaaactccatcagcggttaggaactgatcagcatgactaagggccgggagttgttaaaacgttactggggcttgctggtcgtgatactggtggtacttgcactatttctaattcctttaccgtactatattgaaggacccggaagtgcaaacaatttgaagacttttgtgaccgtcaagcggcatccggatcatcaccggggtaagtttatgttgacctcggtcgcagaagctcgggcgacgccgctgatgtggctttacgcacaattgaatccgcactatgacgtggtcagtgctcaggatatgactggcggtcaggatgacgcgacttataatcgggttcagaagttttatatgcgaagtgcaatcaacgaagctatcgcgacggcgtattcggctgcgcatcagcaataccgcaaggtttatcagggtatctacgttttaacggttcagtctaattcgaaatttagaaaccagttaaaagttggcgatacgattacgaaagtcgatggccaccattttaatacagccagtgcgtatcagcattatattggtaagcagggcgtcggacatcgagtgacgatcacgtatcggcgaaagggccacttgaagcaagcaagtgcgcccctaatcaagctgagcacgcaccgcgccgggattggtatcggcctaactgataatattaaagtgacgacgactattccggttaaggttgatcccggacaaatcgggggtccctcggccggattgatgtttagcttgcaaatctatcagcaattgactaatcagaatttgcgacacggacggaagattgcggggaccggcaccatcgatcaaaatggacaagttggtgaaattggtggtatcgacaagaaagtgattgctgctaagcgggcaggggcgacaattttctttgcaccgtatgtgaaaccaaccaaagcgcttttggcggttgaagaaaagggtcaaactaactatcaacttgctaaagcgaccgcgaaaaagtacgcgcctaatatgaaagttgttccagtgacctcatttaaacaggccgttcattatttgcagacacaccaatagtaaaattgaaatgcaagttagcaaagtttggggtaaaacccaaacttttttcatgggcagccgctccttttgcgtaactattcgctgaaggggtgaaaacaaatgatagattggattaagctgctcaaaatacactggcggattgttggtggtgttactgccgtgatcattattttgataacgggatgggcactgagtcaacttaagcagcctcaacccgccggtacggataacttgttggcgcattcgttcaattccacatcaatgggaggcgcgagtcgaacgtctgccaatgctgaccagcccgcaacgagtacccaaccgtcgaacgctacaccgagcccagcccgaccgacaggtgctagttcacccgggtatgtcgatattaagggtgcggttaataaaccagggttgtatcaggttactgctagtatgcgggtcgcggatgtcatccaactggcacaaggcatgcagccacaggcagatgctcggcagatcaacttggctgccaaagtaaccgatcagcaagtgatctacgtgccagctaagggcgaacaggccccggctgttgcgccaccagtcgtccagtcaacggggcctactggcggaacaccaactagtgatcatgcggcaacggataaggtcaatctcaacacggctgatgtggccgcgttgcaaacgttgagcggaatcgggcagaagaaagctgaaaaaatcattgattatcgccagcaacatggtaattttaaaacaattgatgatttgaaaaacgtcagtggctttggagaaaagactgtggccaaatacaaagaccagctcaccgtctagtttcaaagcgcacattttggtatactactgtcattgaaagtgaggcataaaatgatgaaagatcaacgaattccatgggatcagtattttatgatgcaggcggtcttattggcgagtcgaagcacgtgtgagcggctttcggttggtgccacgattgttcgcgacaaacgcattattgcgggtggttacaatggttcagtatccggcgatgttcattgtatcgatgaggggtgttaccttgttgatgggcactgtgttcgcactattcacgcggaaatgaatgcgattttgcagtgtgcgaaattcggtgcagctacggatggtgctgaaatctatgtcactgactttccatgtttacaatgcacgaaaatgttattacaagctggaattcaaaaaattcattatttacgtaattatcataacgatgcgtatgccatgtccttaattgaacgaaaacacgtggctttacaacaagttcagttcgaccaatcagatttggataagctgaatcttgatcaaatcttgttagatcgtgactaattgcgtgcactattttttgctgccattgcgtgcggcttacttagtagttggttagttgaccaacaatggctggcagccggattattattaatttggttattgcgagtcatccgattacgagatcgacagtgtttgatggtgacgattggctgtgttttatctttggcaatctggctgaactggcaaaaccaccgtttcgcctccattgttcagcggcccagtcaggtggtcacaagccatttggctgtccaacccgatgcgattacggtgcgcggtggtcagtatcagctgattgccactagtccaatgggcaaagtacttgttagaggacagctgaaaagtgccactgaaaaacagtatctgacccagtttactcaccggacgatctggcacgttcagggggaagtcgccgccatcgcacctcctaccaacccggggcagtttaatgcgcctaggtattatcgcagtcaaggcatcgcccgccaagtaacggtcacagcggttcaacgaatagaaattgcgtcgcggcgtggttggctggggctacttgatcgattacaccaatggcgtcagcaattctttctagcctgtcaaagattgccaccaacgcttagtcgttatgcgacgagtctactggttgggatacgccccacagattttcagacgacaatgggggccgttcaacagctgggactattgcatttgttcagtttgtcgggtatgcatgttattttattagttaaattcttgcaatgggtcttgttacgactgcatctaagtcagcaagcaatcgatatttggttattagggctcttgccagcataccttgtcttgggcggcggtgccgatagcttgcggcgggcagttgtaaccgcggctttaccaattatttggcagttgctaacacatcagtcaagtggggcgttgggtggttggagccttgccctgataatggggattgcccataatcctttggtattgagccaattaggtggtcagctcagttatggactagccttgctgctgatcttaatgcctggtttgccgccgtggcgattagcaatttggattcaggttatcagtttaccggttttgcttgtagctacggcgcagtggcatctgtggtccttagcagtcaatttggtggttgcgcctatttttagttgggtattattaccggtgacggtcgtgggggcgagcattggctttggttctaccaatgtcaccagcgtgtgtgaatgggtgttggttaattttcagaattggcttgagtgggtcagccattggccaggcctactcattatcggtcaaccgagtacactgtgggcatggacgctcagtctattgagtttgtggttgttacggacaccgcggcgtcggtattactggcgactgttactggcatatgcttgttttagtcttagtctacgttttccacttcacggtgccgttcaatttatcgatgtcggtcagggcgattcgatcttgattcgccaaccatttaaccgccaagtgagtttgatcgatactggggggcaactacacttttccgggccacgttggcaggcagagcaggtacaaccgcgatcgcgtgcggaaacgattacggtcaattatttgcaccggctagggatcactcacttggatacagtttatttatcacacaaggatgttgaccatattggtgatttgggtgaactattacgcttgatgccggtcaatcaagtggtggtacctgccggaatggcgcgcctagccaagtttcaaaagctgctagtgcccgccagaaagcggcctaaagtggttgaagcattggccggccagacgtttgcagatggattggttgcggtgcatccgtttaaaccgggacgggctgaaaatgaagattcgttggtgctaacgggagtttttggtcagcaacgtttcatgtttacgggtgatcttgaccgagcgggggagcgtgcaatcgttgcccgatatccacaattacgcgtggacgttttaaagctagggcatcatggcagtaaaacagcctcggatccgttagctttgcgccaattaggtgtgcaccacggtattttatcggtgggtcggcacaatcgctatgggcatccgaatcaagaaacactaataactctagctgaacagcatattgtcacttattcaacggcttttcaggggatgataacctatcgtttcgttaatcatcgccagggacgttggcaaacatttttaaaggaaggtgatcgccatcaacgcacaacaggcgttaaaatcgattcgcaacggtgacttggcatcgatctatgttatcttgggaacggtcgactatttggccgatcagctcaaacaggcttttacgcagcaaattcccagtgaagaacaaacgatgaacgtcggcagttatgatatggaaacgacgccagtagctgtggctttagatgatgcaatgtcggcaccgttttttggtgaacggcgattagtctttattaatcacccgtactttttgacgggtgaaaataagaagaccaaggttgaccatgatctggcctcactacagcactattttgaacaacctgaaccaagtacgattctggtgtttatggcaccctatgagaaattagatgcgcgtaaaaagctcgttaaaacgttaaaaaaacaggcgacgacggttgaagtcaaccaagtctcggaggctgaaacgcaacgctatgtgcaagcggcgttagatgagaaacagattcgcattgatgcggacgcactacaggaactggttaatcgaactgacgggcagttgggactgattatgggacaattaccgaagttgatgatttacgcagcccaatcccaacgaattgatttagcggcagttcaggctttggtgactaaatcactgacgcaaaatgtttttgatttggtcaacgatgtacttcgttatcagacgcagtcagcggtcgaactttaccatgaactggtggcagctcaggaagccccactaaagatcaatgcaatcttattaggacaattccgattgttgctacaggtcaaaattatggcgcgtgcaggctatagtcagggcagcctagctagcacgcttaaagtgcacccatatcgggtcaaactagccatgcaaacggtccgccattttgatcaagctgcgttacgggcggcgtacttaggactgctccaaacagaagtacaaatgaaaacgacacaacgcgacccggagttgctctttgagttatttatggttcaatttgttgatgagcgacaggcagcggtcggaacgcggctgtcccgttaggcattggcttgttggacaagcgagaacgactattcacgaaggcaaaagtaatagtgcttagatatggagcccaaaaaaagatgaggctgtgacataactagcctctgtataagcaaatgggacgagaaaccgaattttggtttctcgtcccatttgcttacgcctttgatttttaaagttggtccctaccgtgaccagtttcataatgtttaacgccagtattacgattccggcttccttggtgaccttgtcgaaacctcgcaccgagaatcgattgaaatgtaaagaagccttcatcttgccaaaaactggttcaacatcgatcttacgttgagcgtagatctgaccagtttctggagctgaaagtaattctcgttgtttcgatttgaaatattcccaattttcgttcacggaaatccttttaagatatccttttggtgttagtgccgcggaaattagttgatgattttcatcatacttttcggcaatgtattctttaaagtcacgggtaaaaccatacttatcagtccgttgacgataagcattaaaattaaaccggacgttttgtggattgataaaataatcatctttttcatgatagtcccagttcataaccttacggtcatcactttgccattttcgactattctctttaagcattgtgccgtatggaattaaaacggtatgctgaccgaattcatcttccaagtaccgataattactttcggaaccgtatccggcatcggcaacgatggtgtgacctaacacattgttggcctttaaatgttcaataaacggttgtaaggttcgtgtgtcggttggattttggaaaagccgatatcccgtaatgaactgattactcgtggcgatttgaacgttgtaggcaggttttaattgaccgttttgcatcggatcttccttgacccgcataaaggtggcatcgtgatccgtcttagagtagctgttacgttgatcataaatagcttgctgtgcttggtgttcacgcattttatcacgtcgtttatccaacttacgtttttgtgatttaacagtccggcgttgctgtttggctgggttcggggaaacctgcttagttgcttccacggtttcattaaggaccactaagtgatcctcaaccttgctaatcatgatatccaatagttcgggagtcagctctgatcctgccggaatttcaccgacaattttagcttcatgaagctcgcctaacaggtcaacgagtttttcgcgattcatcttgtcaaatcgtatcgtattcttcttccaaacaaagctatacttgttggcgtcggctaggatcttagttccatcaataaatgaaacatcatcaatcatgccattttgacgaagatattgagttaattgtgataagctatcggttgtcaaagtggccagttcatcagaaattctaaagcgacaaatcgtccggtaggacggaatttggtcggcaattaaccacccagctggcttgttttcacgggcaaaccgttcaattttacgactgctgaaaatgccatagctgtacgctaaaaggaccagttttaacatggcaccgaggttatattcccgcggacggccaaactggtaatcatattttagttttaaactctcaacaagctggttgatgtaacgagcagaatgatgctcttctggttggtaatccaaggcaatactcaaagtggtttgattcatgttataataatcttgcatattaggaatgtcctttcgaggataatttcgtagagtatcgggtgcgaccgatgctctttttttattttctattatatcaaaagcaggtctggaaaaatccgaagatttttccagacctgctttgtttctagagacttatgtcacagcctcatcttttgagtcattaaaggcgataaaaaaacgccgtcgcaatgctcgggcgtaaaattagcttatttagcgtaacgtgcagccatccgtgacttgtcacgggcagctttgttgcgcttgataagacctttagaagcagccttgtcaacggcgctagttgctgctaagtataaatcgtcgacgttgtcggcaccagcagttttagcagcttcaaattttttaacagcagtccgcatcgcactcatttgggcggtgttacggacgtttgctttattgtttgttttcacgcgttcaatagcggatttgataattggcatcagattcacctccatcattttttcaacaaatgctattatacataagccccggcttgaatgcaaccgttatgtgtaaagtaatttatcttgatatgtattgaaacttgctttttactccttagtttgctagactataccaagtgttcagcaaccctttacttagtttttcgtgcaccaccaacgatttactcagtttagggcaattattggaaaggtggttgaaacacatggcaatttcacgcgaaaagaagacggagcttattaacaagtatgctcgtcacgaaggcgatactggttctgttgaagtccaagttgcagttttaacggaagacatcaacgaattaaacgaacatttacgagttcacaagaaggattttcattcacaacgtgggttgatgaagaaaattggtcaccgtcgtaacttgttagcttaccttcgtaaagaagacgttaaccgttaccgtgacttaatccaaagtcttggtcttcgtcgttaatattgagattacgagaactgcctgcgggtggttctttttttgtgtaaagaattacagaaacgatacataaactttattaaacccaaacaaccgttcgctatacttatgtttattcaaaagtgaatgaggggatttcatggaagcaatggcaacgttgactcgtaactttcgggtcttatggtttggcagtttaatcactgatttaggtaacgcaatgacgttaccgtttattgtgctgtatattcagacattaggcgattattcaacgacccagttgaattttctaggggcagcggcgtttgccgtgacatacgcctgtaaagctttagtcgcaccattgtggggccgattggcagatcaaaaggggcgtaagctgatgtgtctacgcgcatctggcatgatgaccttaacgattcttggtgtgggactagcacctaacgtgatcgtcctcttgattttacgagccgcacagggagcgttttcaggttacatcaataatgctaacgcactgatttcgattaccgtacctgcggaacaacgtggccagtggttaagtaaactggtcactggtagcatcagtggcacattgatggggccgcttttgggaagcttgctggctaataccgttggctatcggggggcgttcgtggctactagtagtttgatggcgcttgtctttgtcatgacctggtggggtgttcaagagaaggtgacggcagttagtcgcgccacgttaccaccattgcgaccaatcttacatcaattgggtggtcgctttatttgtgccttgctgacatcgttactagttgttcaggcgacgaccaatgcgataacaccactgttaagcttgctggtcggacagttagcgccccaagcaacggcgcagacgattatcttgatgacggggattgtggcggctgcgccgggacttgccacgattctaatggctggtcgtgttgggcgcattctggatcggctgggcgctggccgttgcttagttatttttttgattttagcgattgttgacttattgttgactagtttagtacatcaggtcgcgtggctggtcgggctacggctaatactgggaattgcggatgcggcactattgcccgcgcttcaagtgatgacagtcgagcatgtcccacacgcagcgtttgggcgtgtgtttagtttaaatcagtccgcgcaagcttgtggtaacgtggtcggccccgggttagccgtgattgttgccaattggtgggggtatcagtcaatctttattgttacggctggattacagctgatggcattgatgctgtgggtcgcgtattttagtcagcaacgaccacattagattgcattgaatggtctaactattgttttactttaaaatgtggtaaactggggagagttacttaatcggaacaggtacgctggtacttgtaaattttaatagaggagtttttagatcatgaactttgcaaacgttgatttgatgaccgcaatggtgacccctttcgatgatcaccaacaattggacgaaaagcggttagcaagtttgattgaacatttattggcacacggcacccaaggtattctggtgggtgggacaactggtgaagcaccaacgctaaccgaagatgaaaaattaaccttactaaagaaagcagctgagattgtcgatggtcgggtaccaatcgtggccgggaccggctcaaacagtaccgctgctaccatcgcatttactaagaaggttagtcagattaaggggattgatgcagctttagtggtggttccctactacaacaagcctgatcaagctggtatgattgcccactttacagcggttgctgatcaaggtggcttaccagttattatttataatattccgggccgggttattgtgaagatgaccgtggccacgatcttaacattagcacaaaatcccaatattattgggattaagcagtgtgcgacgatggaagagtttggcgcgattgtcgaaaatgcaccggctgattttcttgtttatactggtgaagattctcagagtttggctgccaaggaaattggtggtgctggggttatctcagtggcaagtcatatctatggtgacgaaatgacggcgatgtttagtgccatcgaccagggtgagattgccacggccgctaagtatcaacgggacttaacacccaagatgagtgccttgtttagtgcaccatcgccatcgccagttaaagcggccttaaatcatttgggtcagccggtgggtgaaccacggttaccaatcttaccattgagtactgaacaaacggctcagctttttaaaacattaaacatttagaagaatcaaggtgaaataattgagtagtgaaattcaaattaccccatttggtggggtccgtgagaacggcaaaaacatgtatgctgtcgaagtcgatggtgatatttatattttagattgtgggttaaagtacccggaaaatgagttattaggaattgatatcgtgattccggacttcagttatttgcgagaaaatgctgatcgaatcgtcggtgtctttttgacccacggccacgctgatgccattggtgcgttaccgtactttttgaatgagttcaacgttcccgtgtttggttcagagctaaccattgagttggcaaaaattcaattgcaaaaggaccctaaagctaaaaactttaatgacttccacatcattaatgagaagacagaaattgattttggcacggtcacggtttcgtttttccgcacgacccattcgattccagattcaatgggaatcgtgttgcaaaccagtgccggtgaggtcgtttataccggtgactttaagtttgatccgacggccgcaggcgactatcagactgattttgcgcggttggcggagattggatcaaaaggcgtcttggcgttacttagtgattcagctaatgcagaaaattatgaacagccggtcagtgaacgtgaaattgcggcctatgttttagaaacgtttaaatatcatccaggacggatcattgtcgcttcagttgcatccaatatcttgcgtattcagcaagttttagatgccgctgcaaagtctaatcggaaagtcgctttaatgcctggtgacgttgagagtatcgtgaagaccgcaatcgatttaggcaagttacacatgcctgaagacgttgtcgtgccacttaaagccattgataaacttaaacctgaacaaatcgtgattttacaaacgggccgaatgggcgaacctattaaggccttacaacggatggctaataagcaggagagcaaggtcaatatcgaaaagggtgatctggtgtttattactaccacaccgtcacattcgatggaaaccgtggttgccaagacccgtgatatgatttatcgtgctgatgcggacgttaaggcgattgctgatgaaatgaattcctccggccatgccgctaaacgtgacttgcaaatgatgatcaacatgatgaagccccaatatttcattccgattcaaggggagtatcgtctgttggatgctcatgcggactttgcacgtgaagttggaattccggacgaccatgtcctgatcgcagccaagggtgaccagttacgttatgacggtgataccatgcacttggccggttcaatcgaagtcggcgatacgatgatcgatggcatcggggtcggtgacattggaaacattgtgttacgtgaccgcaagattttgtctgaagacggtattttcgtggcagtggtcacgattgatcgcaaaaagaagaagattattgccactcctaagattacttcacggggcttcgtctacgtcaagactagtaaagacttgatgcaagagagcgctgagttagtcaaaacgacggtgcaagaaaatcttgataataaagagtttgattggggccatttaaaacaggctgtccgtgagaagttgaaccattatttatgggaccagaccaagcggcacccagttattttaccggttattatggaagttaatcagcatcatcggcgtacaaagaaggctaaaccagccaaaccagtcgagactgaatctaaagcttagtattaaaaaagtcggaagctacttccgacttttttggttacaatgaagaggaggaaggttcaatgacaatagctgaaacacaattggccgccgaacaagccagtcgagctcaggattggtccaaggcggctagtttgtgggagcaagtgtatcaggcacagcaaacggcaccagttaattacgaattggtccaagcgttggtggctgatcaacaatatgtggcagcagctaattatgccagtgagtttgaagcgcagtatttagcaaccgatgcggccgcagatctgtatctgaatgcattggttgctaatcatgacttcatttctgcccacattatgatcaaggcacgcccaacgagtgcgtggactacggctgcaaacacaactttaaaagcggcggagagtacggctgagcgaacgctaggatcgacattgaccacaacaatgcgtcatttttatcatttatctgaccagcccgtccagaaacaggtggcaggtttgcaagcagcccgtcacctgccatatgagaactatctgacggcagccaagtttctattagtagatccgtttttgcatcccttaacacgagtagaagtgttatatacactgtaccaattgcaagtatcagagacggtcaagatgcagtggctactggatgagaagatgttgacactgtgtccagcaaagttagtcgcactcggtcaggacgagacgagcaaggccgtttaccatgctttgaaagtgcgacttggtaatcaagatgtctttttatatgaaagcttacgagaacttttacaattgcaattaatgtatttatatccatgcgctgcacaggttattacagattccacggcttggatcgatcttttgattagtttgcaaactgggcagacgataacgccgtctgatgaccaaactgaaaaaatgatgaaaattcagcaaaaaattcagcaatttagccttgatttacaatcataagcgtgtgtaataagaatttactaacaaaaattcaattttttgaataatatctgtttacaaatcagattaggctatatataatatttaaggattctcagtgatgggtgcgcgatttggccttttcactaggatgtagtataatactaactaaagaattgttgagaccattttggcctcgacgttattcttgcgaaaatcacaggaggtttcattaatggcaaaagaacattatgaaagaacaaaaccccatgtaaacattggtactattggccacgttgaccatgggaagactactttgaccgctgcaatcactaaggtattagcatctaagggcttggctaaagaacaagactttgcttctatcgatgctgctccggaagaacgtgaacgtggtattactatcaacactgcccacgttgaatacgaaactgaaaagcgtcactacgctcatatcgatgccccaggacatgctgactacgttaagaacatgattactggtgccgctcaaatggacggtgcgatcttagttgttgccgcaactgatggtcctatgccacaaacgcgtgaacacatcctcttggctcgccaagttggtgttgactatatcgttgtcttcttaaacaagactgatcttgttgacgatgacgaattagttgacttggttgaaatggaagtacgtgaattactttcagaatacgatttccctggtgacgatattcctgttatccgtggttcagcgcttaaagcacttgaaggcgacccagaacaagaaaaggttatcatgcacttaatggatgttgttgatgaatacatcccaactccagttcgtgatactgaaaagcctttcttgatgcctgttgaagacgtcttctcaatcactggtcgtgggactgttgcttctggtcgtatcgatcgtgggactgttaaggtcggcgacgaagttgaaatcgttggtttacacgaagatgttcttaagtcaactgttacgggtcttgaaatgttccgtaagacacttgacttaggtgaagccggggataacgttggtgcgttattacgtggtgttaaccgtgaacaagttgttcgtggccaagttttggctaagccaggttcgatccaaacccacaagaagttcaagggtgaagtttatatcttgagcaaagaagaaggtggccgtcatacgccattcttctcaaactatcgtccacaattctacttccacaccactgatatcactggtgttattgaattgccagacggcgttgaaatggttatgcctggtgacaacgtaacgttcactgttgaattgattcaaccagctgccatcgaaaagggtaccaagttcacggttcgtgaaggtggtcatactgtcggtgccggtgttgtttcagaaattgatgactaatctctaactgattttcattgattgatctaagcgacttggaagtcttcttccaagtcgctttttttaagaaaaacgaacaataaatcgcgagcttatgcgcttttttagccaatttggtttactttacggtgtcgataggttaaacttaacaagtatgcaattgactagaattgtagaaattataatgtttcggagggaatacaatggctgcaaagtgggaaaagaaagaaggcaaccaaggcgaattaacattcgaaattggtgctgataaaattagtgaaggtatcgacaaggccttccaacggactaaaaagaacttaaatgttcctggtttccgtaagggtaaggttccacgtcaaatcttcaatcaaatgtatggtgaagaagcactttatcaagatgctttaaacatcgtgctcccagaggcatatgaagaagcaatcaaggaaactgaaatcgaaccagttgatcaacctcaaatcgatgttgatagcatggaaaaaggtaagccttgggtattaaaggccgttgtaacggttaaaccagaagttaagcttggtcaatacaaggaacttagtgtaacgcgtcaaaatactcgcgtttatgctaaggatgttgatgccgaattagaatcacggcgtgaaaaacaagctgaattagttttgaaggaagaccaaccagccgctaagggcgatacggtggttattgatttcaaaggattcgttgatggcgaaccatttgaaggtggcgaatcagaaaactactcacttgaattaggttctaactcattcatccctggttttgaagaccaattagttggtgtcaaggctggcgacgaaactgaagttaaggtaacgttccctaaggattaccaagctgaagacttacaaaacaaagaagccactttcaaagtgacagttcatgaagtcaagactaaggaactccctgaattagatgacgaatttgccaaggatgttgacgaagatgttgacacacttgaagaattaaaagctaagatcaaggacgaacttaaggaacaaaaggaatccgctgcacatgatgccattgaagacgaagctttaaaccaagcggttgacaatgctgaaattcaagcaattcctgatgccatgaaagaagacgatattcatcgtcaaatggatcaatacttggctaatatgcaacaacaaggtatcgatccaaagacttactacaagttgactggtactactgaagacgacttgcacaagcaatttgctgctgatgctgaacgccgggttaagactaacttggtcttagaagcggttgttgaagctgaaaacatcaagccatctcaggatgaaattgcggccgaagttaaggatttagctagtcaatacaacatggaagaaagtgctgttcgtggtgctttaacggatgacatgttgtcacatgacattgcgattcgccaagccgttgacttgattgcggattctgctaagcaaaatgccaaagcagaagacaaaaaagacgacagcgacaagaactaattaattcaattagatacaagtcgagggtcttggaagaataattcttccgagacccttttacatagcgtcagctaatcgtaagattaatttaatagctatttggctgacgcctgtgatttactgcgagaatcattcggttttcaaagtggttagccggatgattgaacagataatttcgggtttaggttcgtccatgttatagtagtggacgtagaagacagtgcctaagctggttttagctcagtttttctgttatgattaatccatgtaaatacatcgatgaggtgagaatgaatgtttgaaaataccgagacaaacggccctgtgaactgctcattttgtggtaaatcacaagatcaagttaaaaagatcgtggctggccccggcgtttatatctgtaatgaatgtatcgatttatgtaaagaaattatcgatgaagagtttagcgaagaacaaacccatgaattaacagatatcccaacgccaaaggaaattgtagacgagttagaccaatacgtgatcggccaaaatgaagctaagcggaccctatcagttgcggtttataaccactacaagcgggttaaggccatggctgataatgatgaagagaccgaagatggtcctgaattacaaaagagtaatattagcttagtgggaccaactggttctggtaagactttcttagctcagagtttagcgcgaattttggatgtgccatttgctattgcggatgccacgacgttaaccgaagccggctatgttggtgaagacgttgaaaatattttgctgaaattactgcaaaatgcggattacgacgttgaacgtgccgaaaaagggatcatttatattgatgaaatcgataagatcgccaagaagagtgaaaatgtctcaattacacgggatgtttccggtgaaggggttcaacaagccctcttgaagattttggaaggtacgattgccaatgtgccaccgcagggcgggcgtaagcatccccaacaagagtttattcaaattgacacgaccaacattttattcatcgttggtggggcctttgatggaatcgaagacatcgtcaaacgtcgcctaggcgataaaacgattggtttcggtacggacaccgatggtaagaatgccgttctagacgattccaagagtctcatgcaacaagttgtgccagaagacctcttacaattcggtttaattcctgaatttattgggcgccttccaatcttgactgcgctagaacgtttaacggaagatgatttggtccggatcttaacggaaccaaagaatgcgcttgtcaagcaatatcaacgcctaattgctctagacggtgcagaattagactttaacgatgacgctttacgtgccatcgcgcaagaagccttagcacgtaatactggtgctcggggtctacgctcgattattgaagacacgatgcgggacattatgtatgatattccaagtcgtgaagatgttaaaaaggtgattattactcgcgagacggttgctgatcacgctgaaccagaactggttttagctgatcaaaaagcttcctaacgtttcgttcagaagatcaatagacattactcaggaccgcgatgagttttcattcgcggtcctgagtgctgtttaaatcgaatttgagcgcggatgacaacccgctgcaaaaattatggtaaaatgaatgcaatacgattgcagaaggagttaattcgatggaagtgcataacgttgaacttgtcatgagcgcggtagcgccgagccagtacccgactactgggtttccagaaattgggttagcggggcgctctaacgtcggaaaatcatccctgattaatgtgttgattaaccgcaatagctatgcgcggacgtctagtcaacctgggaagacccaaacactgaacttttataaagttgaagatcaattatacttcgtcgatgttccgggatacggttatgctaaggtatctaagaaggaacgtgagaagtggggacaaatgattgagacgtatctaacaagccgagagacactgcgaggtgtcgttattctagtcgatgcacgtcatgcgccaactaaagacgatgtcgcaatgtacgagtggatgcgttactatgagatgccattactggtcgtggcaactaagagtgataaaattccgcgtggtaagtggaacaaacaggaaagtttaattaaaaagacgcttaacttccaagctgaagacgattttatcgccttttcagctaagaccaaagaaggcaaggatgctgtttggcaatggatcgaagcgcacactgtgggaggcaactaacttggaatttaatgagtatcagtcgttagcaaatcggacattatatggtaatgagcaggtgctgacgaacttatcgctgggattagcttcagagactggtcaagtcgttgacttagtcaaaaagtatacgtttcatggtgaacgtttgaataaagatcagctgacgaaacagatgggcgatgtgttatggtacttatcacaagttgctgaatgggcggatattccgttcgaagaagttgcgcaacaaaatattgttaaactcaacgataagtacccgaatggtaaaccagttaaatagtcggtgaagagtggtctaacctgaagagttgggctgtcagcaggtaaggctggcagcccaactcttttttattgcgacgaacgaccacatatcatttgcaaaaattgtgtcattattgagttcggctgtttattttcacttttctaggtaaattaattgcatttgcagctgaaatagcgtaaattaaagactgtaaaagagttgtgcacaacttaaatgtttttgaaacggaaaggatgcttaactatgaagattaatatcaaagacgatgctcaagcctaccttgcagataagattccggcagggagtcaagtaattttaacaactgacgatggttctaacaaatattcgagtttaggcggtagctgtgccattggtaataagtttcagttagttattcttaaagccgctgatcccgactataccacgccattagaaaataatgctggttatgtgatgcacgttgcaccggctgatgaagcctacttggggaacggcctcaacatttctcgctggcataatgctttagcgctcaaggatgatagcgggatgctcgacggtgctttggctgttgttgattggcgcgatgtttcaccagaaacggaagcagagcggcgcgaaaagatgcaaacaatcgggactaaaatttgctaaatagttattcaaataaaaacgcgatggctaactgccattgcgttttttttgactgctatttatgggcgtcctttttatcagctgccttattttctttgcgtttagcatgttcgtcaatagtatcctgaaccgctttagtggtgagtttatccttatcgtcaggaccaatggcaaacttgtcgaatagcttatcaaggttatcttgacgctgtacttttaaactcataaaatcattcctttcgattaacgcctatcatagcaaatttccgacaatttgtcagttattcgtcttttatgcataatcaatgggccaaaacgtgtataaacgacttatttatgcataaaataaagaaattctcaaaaatacttgcataaataatcatatgcggttatactttattcttgtaaattacaaaacgaggagaatacctatgaaaaaaagatttgggtggtttttagccattattgtggccctgatcatgaccgtcgtcccactcggacagacgcaacatgcgcaagcggccgataattcattagaacaaattcagaaaaagggcgtcttagtaatggggacgtcgcctgattatccaccgtatgagtttcaagcaacggtcaacggtaagagtaagatcgttgggatggatgttcagattgggaaacaagttgctaaggatctgggcgtgaagctgaagatcaaatccatgtcatttgactcattgctagtggcactccaaactggcaaggttgatatgattatctctgggatgaacccaaccccttcacggcggaaaaatgttgattttacccacgtttattatcaaggtggctacgatattgtcatcaataagactgataagggcaagtacaagaataagaattcattcaagaatggcacgttgggtgcccaaactggaacgactcaatataatgccgtcaaaaaccaaacgactgccaaggctaaagggatgacttcacaatctgatctgattttggcacttcagagtcacaaagttgatggggttgctatggaaaagccttctgcagaagcctatgttgcaaacaataagagtttggttgctattcctagtgacttcaacatgagctctagtgcaacgagttcggcgatcgcatttcggaaaggttcaactagtcttgttaacaaagtcaataagaccgttgatcggattaagaaacagaacctcgttaaaaagcaatacttaccggcagccggcaagtatttgaagaccaataccgttaatacgtcaatgggacattactggaaggcttttgcaaccgggatcgaatatacgttaatcattacggtttgctccgttttcttcggttttatcatcggtattttattggcattagcacggatggctaaaggaaatccacttaagactgccattcggtggttagcaactgcgtatgttgaatttattcgtgggacgccaatgatggtccaagtgatgtttgtgtacttcggacttgggttattcgtcaatttaccagcactgacttctgggattattgcgatttccttgaactctggtgcgtacgttgctgaatatattcgtggcgggattaattccgtcgatgttgggcagacggaagctgctcggagtttaggaatgtccaacggtgaaacgatgcgttacgtggtcttgccacaagcattgaagaacatttggccatcacttgggaacgaatttattacgttgatcaaggatagttccatcgtttcgatcattggggtcactgaattaatttatcaaagtaacattgttcgttcagatacgtaccggggggttgcaccgatcgttgttattatggtgctatacttcatcttaacctttaccgcttcacggatcttgaactacttcgaaaggagaatgcaacatgactaaaccagtaattgaagttaaagaccttgcgaagagcttcggtgaaaatgacgttttaaaggatattacagaaaaagttgaacccggtcaggtgatcgtggtgattggtccttctggtggtgggaagagtaccttcttacgttgtttaaacttactcgagacgcccacaagtggtcaagtcgctttcgaaggtcaagatctcacaactttggatacgaagagtgttaacgcgctacgtgaaaaaatgggaatggttttccaagggtttaatctatttcccaacatgactgtattggaaaacattaaattggcgccgatgaaggtcaagcatgtcgatgatgccgcggcgactaagcaagcgcacgaattattgcaacgcgttgggttggacgatcatgcggatgcctttccaagtagtctttcaggtggtcaggctcaacgggtggcgattgctcgtgcgttggcgatgaaccctgaagtgatgctgtttgacgaaccaacgtctgccttggacccggaaatggttggggaagtgttaaacgtgatgcaagaacttgctaaggatgggatgaccatggttgtggtcactcacgaaatgggttttgctaagtcagtagcggatcgaatctggttcatggctgatggctatattcaggagaataatacgcctgaggaattctttgcgaacccgcaaacagagcgggcccaagattttctttctaaaattttgatgtaaacaacacataaccggtaatcagctcagttgctgattaccggttttttgctacactgtgatcagtagcgacagtgatgaatagtcggtcataataaaaatcatatttccgggctgtttggttgagccccatgctagcaggcggtatactaataatgctaatctaaatgaagggaaggtgtgttatggcatccgcgcatattgaacataagttatctttgttaccggacttaccaggatgttatctgatgaagaacttaaacagtcagatcatttatgtgggtaaggccaagaacttgaaaaatcgggtgcgttcatatttcaaaagcagccatactggtaagaccgcgcggttagtatcagagattgcggactttgagtttattgtgacctcaacggataaggaagccttcctgctagaaattacgttaattcaaaaacatcaaccgtactttaatattaaattaaaaaagggaaccggttatccatacattaagattaccaatgaacgagatccccagatcctgatcgtcagtgatgttcgtaaagacggtggctactactttgggccatatcccaacgtttacgcggctcaggaaacggtcaattttattcagaaggtctatccgttgcggcgttgccatggtttccagaagcggccgtgcctctattatcatatgggccaatgcttgggagcttgctttaaaacggtgccggtggcagaatatgacgctcagatcaagcggattaaatcctttttgaatggtcacgttgaaacggtcaagaagcagttaactaaacgaatggatcaagcggccgctgacctagaatttgaacgagccgctgaattacgtgatcaactgaattatattgaaatgacggttgaaaagcagaaaattatttcaaacgataatacgccccgcgacctgtttaatttctatcttgataaaggctggctttcgattcaggtcttctttattcggcaagcgcggttgatgaagcgcgagaaacgcttgttcccagtagtgtcaactgcacctgaagaaatgacgagctttatcttgcaattttataatcgcaaaaataacgttctaccacgcgaagttttagtccccaacggtcttgataagcaggtcctgagtgacattctcggaattccggtaaggacccctcaacgcggccagaaaaaggatttgctggacatggcacaaaaaaatgctcgaatcgtcttagaagagaagttccggttgttggaattggatgagcgcaagacgacgggggcgatgcaagaaatcacggatgctttaggcattcctgctggtcataaaattgaggcttttgaccactctcatattcagggggccgacttggtttctgccatggtcgtcttcacggacgggcaaccgaataaaaaattgtatcggaaatataagttgcggacggtcgatcatgctgatgaagctgcatcgacccgtgaagtgattcggcggcgctatacacggctactgaaggagcatgcagcattgcccgacctgattttgatggatggtggcgagatccagctggaagccgctaaggacgtcttagagaacgaattagggattgcaacgccagtcgcggcaatggtcaaaaatgaccatcataagacggcggacctactcgcttctgctggtgatcagcatttgcatctagatccgaagagtcaaggattttatttattacaacggattcaagatgaagtgcaccgctttgcgattacgtttcaccgacaagtccataccaaacattcattgagttcgcgcttggacgagatccccggggttgggccgaagacgcgtaataagttgttgcgtaaatttggatcgatgagtaaaattgctggtgcctcactggaagagattcagtccctgggaattgctaaaaacgttgcacaaactgtcaaattttcattagccggtggtggtgtaacaccgaagcattatcaaaagggcgccacatagttgtcatctggctaactaatgtaattaatgttaagaagaccatctagttttcacgaactaggtggtcttttttgatgcttgaaaacatcattgatttgtaaaaatgtcgattttgtgattagttgaaaagcacattggttgctggagtaaccgatgatttaatcgaaataattgtgggtaaatacgagctaaaataaagtcaaataattatacgatttatattattttgattagtaactatcaataaatataacattattgtctataatgtcaatttaaatttagagattgtcgaatattcgcttgtatttatatgagtttcatgaaaattcgtgaaaactattgcgtcgtttgcaactggttttctacaataatgtcaatcgtttaataaaagtcagtcaagaaatattggagcgtgtggaatggagcaagtaataacctttgattttattgttaaactcattcgtcagtattggaaggtattattgagtttaatgatttttggcgggacgattgcaacagtggtgactttgtgggtcattcagcccgagtatcaagccaatgttcaaatattagtgaaccgcaaacacagtagtgcgggcgcggatttgacgggccagcaagccgatgtgcagatgattacgacttataaggaattaattacaaaaccagtcgtgttgaagccggcacggcagactttaatggcagaaactgacattcgacgctcacttgagtcgcttaagcaaacggtcagcgtgaccagtacggccaattcgcaggtgttttcaatcgttgttcgtgataaaaatgcgaaagctagtgcaatgattgcgaaccaaattgctgcaacgtttaaagatcaggtccagcatattattagggtcaataatgtaacgatcgttgcacccgcagagacgccggatcagccggtagcgcctaaaaaaatcatcaatatcctaattggtttcgtgggggggctgattttgggattggtgtatgcaagtgtccgaatcttgtccaatcggcgagtgcagacactcgaatacctagcagatgaattaatgctgacaagtctaggaatcattaatcatcaacagccggtcacagcgactcacgaccaaccggcaattaaaccacagccggtgacgtcagttgttaaagcggcagtcaaacgagtttaacataggggggaacggttatgaaattgaggcgaagagtagcgaatatgcataccggcatacagttaacaactttgacggcaccgatgtcagtcgtaactgagcaagtcaaaacgatccgaacaaatcttaactatgcgatggtcggtaaaccgttgaaaacactaatgatcacgtcagcgattcagggcgagggaaaatcaacggtcggcagcaacttagccgtggaatacgccaagaaaggcctgcaagtcttacttgtcgatgctgatttgcggcggccgacgattcatcagacgtttgcgatcagtaatcaacggggagtgagttcatggttaagcgggcaactgacggacgtgaacgaggccatttatcccgtacttgatcatttgtttgtcatgccgagtgggcctaaaccacccaatccagctgagttattagccagcgatagaatgaccgagtttttaacggtcgcaacacgtaagttagatttagtgattgttgatgcgccgccgatactgcccgtgaccgacgctcggatcttagctggtcaagtggatggcactgtcctagtcgttcgccaaaactttgtcgaaaaagttgcggtgcgccaggcagtgagtgccttgaagaatgctcgcgcacaattactcgggactattttaaatgacgtggacattaaaactcacggttatgggtacggctattatgggactgagaccaactgagtatattgacctgcactgtcacttattaccgggattggatgacggcccccagcagcttgctcaggcagtcgaaatggcgcgacaagcggtggctgatggcattcattacgtcttggcaacgccacatcatctagatcggcgttatcagaatactggcctggtagttgagcgggccgttgccgagctccaggccgaacttaagcggcaacaaattccactgaccgtttttgccggtcaggaggtccatttgcgagatgatttggcgacagctctgccgcacttgctaggaattgatgttggtcggcgctatttgttactagaattgccacacgagcaggtacctaattacgtggcgcaagtaatttttgagctcttacagcaagggacgactccggtgattgcccatccagagcgaaatgctcagattatggcacaaccagagcggctctatgatttagtgcagcagggctgtttggcacagctaacagcggggagtctcgttgggcaatttgggcgagcggttaaaagtacagcgctggaattagttgaatgcgggctggtccaagtgattgcttcagatgcgcatttgatggcacgacgaggatttatgatgcgggcaggttatcaggcattagcacggttagatagtaccaatcctgcatcttttgcagtgaatgcaagactgctactgaacggggatccagtagtgttaggggaagtcttgcgaccaaatcaacgacgaaaattttggcttttttgagaggggtaaatagttatgaaggcattggtaacgggaggtgcggggttcattggctcgcacttggttgatcatttagttgaatctggctttgaggtggtggtggtagacgatctgtcaatgggggccatcagcaatatcaagcattgggaacagattacgatatacgtcgcggatgtctgtgacgataaattcatgcaacaattgttagcagacgaacggccagactatatttattttctggcagcgattgcgagtgtggcggattcgattgagcggccggcagaaacgcatgctgtcaatcataccgcggtatttaacttgctcgaacatattcgccaaattcgcttgcctattaagcaatttctattcacttcttcggcggcggtttatggcaatctacctgaattaccaaaacgcgaggattcgcgcgtcgcacccgtgtcaccgtatgctattgataagtatgcgactgaacgttttgtattggcatacggtgagttgtacgatttgccgaccgtttgtgtgcggttcttcaacgtttatggaccgcgtcagaatccaagctcaccgtattcgggggttttgtcgattttgacggattgtttgaaaacacagcgaccatttacattattcggtgatggaacgcagactcgtgattttgtatatgtaagtgatgttatcaaggcattatggttgattacagaacatcaagtgcaacatgaagtgatcaatattgccaatggcttagaaactagtttaaatggcattattcagatgtatcaagagattgctggtcaacaacttgaaatcaaacgggccgagcagcggggtggtgaagttgatcattcagttgcaagtattggcaagttggcacgcttaaattatgaatcagagtggccgttgagaagaggattaactaagtactgggaaggggaatgtgagcatgcacgaagttgagattaatgaatcaatcgtggctgacgaacaacactgtgaatttattagcaaaattggtgttccggtcaccggctggaagatggatctaaagcggtgtttcgatctagcagtcggcttattgggcacactgctcagcgttcccatcgtaattgtgtttgccatacttatcaagttgacttctgacggtcccgttttctacaagcaggagcgagtcggttggatggggacgacctttgacgtgattaagctgtgatcaatgtatcaggacgctgaggcgcagacgggtgcgatctgggcaaaaaaaaatgatcctcgggtgacgccggttggacgctggatgcgcaaaactcggatcgatgagttaccacaattttggaatgttttgaagggcgatatgagtttggtcggacctcgcccggaacggccagaactaaccgaacaattcagtgaacgctatcctgattttccgaaacggctacgaatcattcctggcattaccggctatgcgcagatcaatggtggctatgatattacaccgggtgccaagtgtcagtacgataactattacattgagcacttttcgatttggtttgatatcaagatgctgatgggaacggttagggtgattatttccggggatggtgcgcggtagtgaagattgtttacatcattactcaagcgacttggggtggggcccaggcgcatctatatagtttgatcaaagcgcaagtgatgcgtggcaatgccgttgccttagtatacggcgttgaaggacgcctgagtgcaagcgtcgcgaaagaatttcaagacgtgcaagttgtcagagttgccagcctggtacatccgattgcaccgctgagtgatttgaaagcaatctacacgttaaggaaattagtaaaaaattggcagccagatattattcatttgcattcttcgaaggctggtatgattgggaggctcgccacgattagattgccaatgaaagtcatttttacggtccatggctggggctttactcctggtgtcgggaagaaacggcagctattgatgaaaactattgaaaaagcattaagtcgcctgacaacggcttacatctgtgtctcgcagtttgattatgatttgggtgtccaaagtggtgtgattactagtgctcatcctgctcgtgttatccataatggcgtgacagcattaacgggcgcaaacaaggcgaccagttccgaggtctttgtactatcaatggcggcacgctttgatacaccaaaacggcaggatatcctgattcaagcattgacatacttgccggaaaatctaccaatcgtgtgtcattttctgggtgacggcccttcgattgaagcctgtaaaacgctaacgcaccagttgaatctggatggtaaagtgaacttttatggggtggtggataatgtacaaaaatattattctcaatcggacgttggggtgctgatttctgattatgaagcactcccaatcagtttagtggaagccttagcccaaggtctgccgattattgcgtcgaatgttgggggcattcaggaattgattgatcataatggctttttggtcaccaatgatgcgcgccagattgctgaaaaaattctgacactctatcaatcgaaaaagatcgccgaggtcaagactaattcctatcaaatgtatcaacgtcactatactgagcatgagatgctcgaacaaacgcaggcgtactatttgcgttgcttggcctagaagggacgattgtcgatgacaaaaattgttcatgtcttgttttccgccaaattaggtggtgctgagcaggtggtcattaatatcagtaggggtttgagtggatcctatgatttcacctactgctcacaatcaggatcgatacaagaaagcttgcaagctgtcggaatcgcgtatcaaagtttttcgccgaaacagcttcttaaatttcggcgagctattctggcactccagccagatattattcacgcacacgatttcaaagcgagttttttggtcaacctgctttttcaccatgtgccaattatcacccatatccatcaagccccgatatggcagactagtgtgaactggaaaagtttggcgtttcaatatattggcaacaagagctcacgagtcttatatgtttcagattgggctaaagaatcgtatcgcttccacaaacatttaaccaatacggcgattattcccaatggaatcgacagttcacggatttgccaactggctactgccagtacaaccactgcatttgacctgttattcgtgggacggttggaagatgttaaagatcccgcaagatttgtgagaattgcgcataaattattagacgcaatccctgaactaaagattgggattgtcggcgatggtagcttgagcgcacacatcgctaaacagattgcagccaccccgcaaatacggtggttagggtttaaaagtaacccttacaaatacatgcggcatgcaaaagttgtgctgtcgacgtccaaatcagacgcgtttggattgaccatggtcgaggcagccttattgggtgcgattccgtttgccccccgcattgggggcatctctcaaacggccgcaagggtaaatggcctggtttatgcgagtgatgctgaattattggcagtactgacacgtctcttttcggatgggaaattttatcaggaaaccaaggctaaaatagcagcggtcgattttagtgactatgaacaaaggcaattcattcagcggatccagcaagtttataaaggagtaatggaacgatgactgcagtaaatcgtcagattggtgggccattcttaagactaggactattgattgccggattttacctgatttaccaacccaacttttggagcagtagttatgtgcccctgattgttacactggggattactggtggttgcgtcttgctattgtcgccaaaggacttatcgattgctattaatcggctgcacatttttgtgattggtgtgatgctatcagtgatttactttgcgttcagagcgaagctggcaggaactgatccccgggtgtttcaaaatgttgtgattattttgaatgtccttgccttagtgttatggctagaagttcttcgtaagtattttaacgtgacaagtgaaacggtcttgacctggatgctatggatggtggttgttcaatgcttgtttgctttggtcatgctggcaagttcgggtattcgcgctgcgattttagcaaaaacagccaccggtattattcagaatcagtttatttatggtgaacgtttgtatggaatcagcagtgattacacattttttaccccaatttaccatagtctgatgggactagttgcgatatatatgggaatgaaccttggcaaaaagtattattggttcctgccattttgtgtctttattatcgtattaaacggccgaactggcttgatcacgctggcttttggttttgccttgatgctggtcaaacgaatgctgtccagtgttcgagggctgtttcaggttgcactgattatcgtgttgagtgtgacctttatcatactgggtttggcttttctgcaatccatccagcctgatacgtatacctggatcgtcagtggctttgaagatacgtttgcactcgtctttgaaggtagtaagcagggcaattacgaacaactgacgggctcgttcttgatgtttccgagtcagcttttagattgggtgtttggttatggcgttcgcgtatatggtggcaatgccaacaatatttggttcggaacgtccgacattggctttattaatgacttatttatggggggcatcatttacatggtgctactgtacggtacgattatagcctcgttgacggcttgccacaaaaagtctggaaaggttgttcgtgatagtaaaatctttctagcctttggcgtagttctactaatcgcaaattataaaggtgaggttgcgcgcagcggcatggtactgacggcaataatattcttggggtatttactttcaactgaattgaagattgaggagaaaaaatggcaatcagcgtaattatgagtgtatataatgaacgacctgagcaagtccagcaagcggttgactcgattttgaagcaaacctatttgccgagggagtttgtgatcgtactggataatccagaacggagtgatttaaaagacttgttaatggattacgattgccgtgtggaaatgatcaaactagtgtgcaatccagaaaacctcggcctggctgctagtctcaataaggcgattgagctagcaagtagtgagttgattgcgcggatggatgcggatgatatttctgtcactaatcggctcgaagtggaattagaggcgttaaaaacgcgcgatttggatttaatttccggaaatattacttatcttgatgaacaggatgaggttgtcggggaaaaatcggccattcccgaggctgaaccactaattcaaaaaatcctgccctatggttcgacaattattcatcccaccgttttaatgcggaaaacggccgtccaacaagtcggtggttaccgtttattaccaacggctgaggactatgatctttggctgcggctgcttgctaatggattcaaaatcgggtcaattaaccgccgagtgttgaactatcggttacgcggtaatagtatgaccagcgacgcgtggaaaacgtatctggtatcgcgctatattcaacaattgtatgcggaacgtaaacggacgggagcagacagtttcggccgcgggatgtcggcgttaacagacaaaataaatgacgtccgtgcccaaagtacgtttaatcgtgggcaaaaatattttacgatggcgatggccagtatgcgcaaacgaaaacttggtcaggccctggctgcgttagtccgcgcaatggtgacatccccagataattgttactatgtgatcaactatttacgtttaagaacgatttggtcggtaaatgggcgccggtatcgacaacaaccaagtgattgaacgtgtgcggtgcttatgagatttgttattagtaagcaggggatgtgatgctcagttcagacctatgagaaaggaatttatgttagtcagtattagaaataaatatcggcatttgccaaagcaagttaaggcctcactttggttcttagtctgtgctttttttgaaaagagcatttcaataatcgcaacgcccatttttaccagaataatgtctacttccgagtatggtcaatttaatgtgctgtactcctggctgactatcgtcacgatcatcgtctcactaaatctgtgctacggcgtttatactcaaggtctcatcaaattcagccatgatcgacgtcgatattcggctgcattacaaggattaacggttgtgttggtattagcatggacactagtttaccttggctttcgtgatttttggaatagtgtcttttctttaacgacggcgcagatgttggcgatgcttctaatggtatggacctcgtcagtttttaatttttgggctggtgagcgccgagttgccttgcaatacaaatcattggtgatggtgaccttgctggttgcaatcgccaaaccgttagtaggcgtattgctcgttgtgtatgcgaatgataaagtgacggctcgatttttagggctagcattagtggaactggtaggctatacgggcttgttttttgtgcaaatgtatcgtggcaaaacgtttttctcgcgccatttttggcgtcacgcattaatgttcaacatcccgttggccccacattatctttcacaaatcgttctgagtagtgctgaccggattatgattgcgaacatggtaaatacgaaaagtgcgggcatttatagtttggcgtactcactttcacaaatcatgatcttatttaacgttgcattgtcgcaaacgctgagtccgtggatatatcaaaaaatcaaggatcgacgggtggccgatattgcgggtgttgcttacggtgccttagttttaattgcggttgtcaacctgctattgattgcatttgcgcccgaaatcgtttcgatattcgcaccacgagcatatgctaaggcgacctggatcgttccaccaatcgcaatgagcgtctttttcatttttgcttttgatttatttgcaaagtttgagttctattatgaacggacatctttaatcatgattgccagtgttattggcgcagtattgaatgtggcgctaaattattggttgattccaattttaggatacgaggtggcgggatatacaacattaatttgctatgtgatgtatgcggcagttcattattggtttatgaatcgaatctgtcgcgaaaaacttgacacgcttccatatgatcgcaagatactggggatgattacgcttacttttttggcggttggctttctatttttaggaggctatcacagtgttgtactccgttatctattgattttgataacggccgtcgtcggatttagcaagcgtgattatttaatgaccattgttaaccaaatgctacgtgtgcgaaaaccaatctagccgaatcgaagtagggtggtgccggtgtgactgaccagctataagtagtgactaatcaaaaagacgacagcctgaaaattcgctgtcgtctttagtttataaagtggttattgtacggacccagaccacgtcacgttgccgtgtagtttcttggtggctaacacgaagccgcgcaaacttgtattgtggggcatttgttgccaagattgaatagcggcgctatttttgactggggtgccccgaaagagcgcgatattggcggccgccatgccgcgggctagctgattaactttagcgcttgatagttgcgtttcgtcacggtcctcatataactgactcagtgctgcgttatagccagccgcatataacacgtcatgatcgtacttttgataggcgcgcattgctttattaccacggtggtgcttgatgtaagcactcacgtttaacggggtcgcgtggtacgtggccgtcccgttactctggttgatcttaagcgtaccgtaatagtgagatcccagtatcagggcgccactggcaatatcagtcagtgactggttcttgactttggtagacttgatattttgagcatgaatatggccgctgagcgataacttgatacccgcagtggtaaaggccttacggacatcttcggcataaccgattgtatagtcctgatgaatcaccgtgtggtccattgtattgtgatgtaggacgggaatgagagtcgcatgggcttgttttgcttgcttaccgactttagtaagccattgtaaggtcccatcggtcaggccaccaccgaccgttgaattaccttgttgataattacttttataaatggcggagtttagcatcaaaaaccaagtgtgtttactaggttttaccaaatatcccaatgagcttgggtcagtttcactggcttggccgtagccgtcctgatgatagatcttcttgaactgggtcgggctagtcgcctcggtgctatattgatgctttcctttgaaacgacgggcgatggggttgttcaagtcgtgattaccggggacgacgtagacgcggatgtgcttagcagtcagtcggcgaagctgcttggcaacgtactcgtgactggctttctcaccgttgttagtaatatcgccactgatgagcacaacgtcaggcttggtgattaacgccttagcaataaaagcgcgaaaaatcgtcgcgctgtattttaaatccgcaccggcatcgttagccgcgtactgcgtgaaagccttaccattatcatgcaggctgggcgcaatgacatggtcatcactgatcaccatcgctgttaaggtcttgtgactgacagggggcagggtcattttagtttgcttttggcaaccggaaagcagcatcatgccgaataatacacagctgatgccaaagatagattttcgtagtttcatcaaactcgtctcgattctcgttaacataatcagtatattactttcattatacccgttttattgcggggttagacggctgattcgttaattttgaaaacaaaaaaaagacgatcaatttgatcgtctttttagatatcacattatttagaagctttagctggcttccagagaccaaggataaccccagcgataacggcaccgataattgtggcaccgatgtagccccagatattcgtggcgagtaatgagacccagaggccaccatgaggagcagggacggcaacgccccaaagttgagttaaaccaccggcgatggcagcaccaatcacacttgaaccgataacgtgcaatgggtcagctgtggcgaatggaatggcaccttcagtaatgaaggaaataccaagtaaccagttagagataccagctttacgttcgtcatccgtaaacttctttggccagaaggcagttgcaatcgcagttgccaatggtggaaccatcccaccagccataacagcggccattaagttcccatgtccagttgcggtaaaggcaccagttgcgaagacgtaagcggccttgttgaaaggaccacccatatcgatcgacatcataccaccgaggacaagcccgaggagaacggcattaccagtacccattgagtttaggaagtgggtaatccaggcgttgataactgagaagattgggttaacaacgaagaacattagcgcagcaataatcaataagcccagaattgggaagatcagcattggcttcatcccgtctaaggattgtggcatgttcttggtccacttcttcatccaaacagtaatataaccggctaagaaaccagcggctaaaccacctaagaaaccagcgggactcttagcattggcggtaatggaggccgtgtaaacaccaccgtaagcgccagtgtaaaccgtggccatgaacccaccaacgaacccgggcatcaaagcaggacgatcaccaattgattcggcgatgtaaccggctaaaacaggtaccatgaaggcgaaagccatgttaccagcttggttgaagaaggtaaaggctaagctcttactaccaacgaattgctcaataatgaaggagagggccattaagatcccaccaccaacaacgaatggcaacatgtgggaaatcccgttcatgaggtctttgtaaacttcaccccaaacgctaccattagcgctgccaccttcatcgtcatccgcagcaccaccatcagcatcgtgatagacaggagctttaccgctcaaggcttcttgaactaattgatcggccttgttgatcccgtcagtaacgggacggttaaccaggtgcttaccatcaaaacgggccatcttgacctttttgtcagcggcgatcacaacaccgtcggcacgagcgatttcatcggcagtcaataagtgcttaacaccttcagaaccattcgtttcgattttgatgtcaacaccggccgcttcaccggctttgatcaaggctgcttcggccatgtaagtatgggcgattccgtttggacaggcggtaaccccaactaaatagggacgtttttcgtcagtggtggtgctggcagctgcggcttctttttcggccttggcagctgcatctttggcttccttttcttccttagcagcctgggcatcaccgaagagttgttgaacttcttcaggtgactgtgcattcttaagtttagcgaccaattcaggatcaatcaataagcttgagagggcggcgagggcggctaaatgggtgttgttggcaccttcaggagcagcaatcatgaagaaaagatgaacgggttgaccatctaacgcgttgaagtcaacgccggccttactcttagcaaacatcacggttgcccggttaacagccttatctttggcatggggcatagcaatcccgtcgccaatcccggtagttgattcggcttcccgtttgatgatgtcttgcttgtagagggcctcatcattgatgataccttgttcggcatatttatgaactaactcatcaatcgcttcgtccttggtcgtggcgtgcatgtccatgatcatgacatcttttagtaataaatcgcggatatccatgtttagttaacagtcctttctttagtgagcgagtttttcaatgttaatgagtggcaaaatttcatcgatcttggcgcgggtcgcaatgtcttctgagaaggcggttgcggagccacaagctaagccgtagcggaagctttcaacagcatcgtgtgttttggcgaacgtgccgacaaagccaccaatcattgaatcaccggcaccaactgagttgattacctggccctttggtgcgggactaaagtagaccgcatccttggtgattaggaggccaccatcgccggccattgaaatcagcacgtgttgtgcaccttcagctagcatccgctggcccgctgcaatgatatcagcctggctattaaacgtcgtgtggtagtaatcagcaagttcgtggttattaggcttcacaacgagggggtggctgggtaaagttttcttcaaagcttcaccggtcgtgtcgatgacaaagttagcaccagcagcttcgaccttctgaataatatcgtagtagaagctatctggtaaactaggcgctaaactaccagacatgacgaccacgtcattcggcgttaaattggccaattcggtgtagaaggcttctatttctttggcggtgatgtccgggccagcaccgtttaattcggtctcttcttcagcgtgaatcttcacgttgatccgggtgtcatcggcaatcggtgtgaagtgacaatctaggcccttggcttttaaagcatcactgataaacgtgccggtaaacccaccgataaagccgagggccttgttgggttggtctaggtctttcaaaatctgcgatacattgatgcctttaccgccagggagtttcgccgtgtgtgctaaccggttaacactaccgagggtcatttggggtagttgcaccacgtagtcaattgatggattgacagtaatggtataaatcatgattgaacctcctgaatcgtagttaatggttgatactgttcggcaacgcttggcgtgagttggtcagtgatgatggttgcactggataaatcaccgacgcgcgcaaacgaaacgtggtcgaacttagtgttgtcagctaagataaagctttcttcactttgtagaattgcggtttttttgacgaccgcttcatcggggtcgggcgttgtgagcccgaattttgggtggacaccgttgataccaagaaaaactttgttgaatcggtattcctctaacgatttaacggcttcgggaccaatcacggctttggtggtgcctttcaaattgccaccaagcaggtaggtttggatgcccatgtctgccaaagcggaagcatggacaacaccattagtcacgacacgtaagttgtagctcggatttaaatggtgaatcatggctagggttgaagtcccagcatccaaataaatgacgtcatcaacttgaatgttcgcaacggcttgctgcgcgatatggtccttggcgttaacgttacgggaaaccttatcattcatcgcgggttcctcttggagtgagttcatatacttcgcaccaccgtgcacgcggagtaactcgccctgttcttctagctgttggaggtcacggcgcgccgtggactcggaacaacgagtttcagaacagatgtccttgattttaataatgcccttgaaacggatcgtatttaaaatgtactgttgacgttcttctgtaagcactttcaaatccctccgcataataatatacctgtttaaacgtcaaaatgcaacaaaaaccttcaaaaaccgtcaaaataatccaaaatctgtcatcaaatcgtcattagcatccaaataaagatgatctgtctaattaggcgtggaacttttgacgaagtggccgaagatttgtatactaggtcaggtatctaatttcgcacgatcggatttcgtagataataatatagaagaaacgggagaaaagaacatgtttgttgatcaagtaaaagtagatgtaaaggccggtaacggtggtaacggcatggttgctttccgccgtgaaaagtttgttcccaatggtggtcccgctggcggtgatggtggtcgcggcggaagcgtcgtattgcaggctgacgaaggattacggacactgatggattttcgttatacgcggaagttcaaagccgcagctggtggcaatggaatgattaagcagatgacaggtcgttccgcgaaggacacaattattaaagtaccgcttgggacaacggtgacggatgctgaaactggtgagttaattggcgatatcgtcaataaagatcagcggttagtggttgccaagggtggccggggcggtcggggaaatattcattttgctagcgctaagaaccctgctcctgaaattgctgaaaatggtgagcccggcgatgaattgacgattcgaatggaattgaaagtcttggccgatgttggtctggttggttttccttcagtcggcaagtcgacactgctttcagtggtcacgagtgctaagcccaagattgcggcctatcattttacaactttagtgcctaatctcgggatggttcgtttggatgacggtcgtgactttgttatggctgatctacctggtttgatcgaaggtgcagctaacggagtcggcttagggattcaattcttgcggcatattgaacggacgcgcgttattttacatctgattgatatgagtggtgtagaagaaaacgatccgtttgaggattatcacaaaattaatcacgagctgacgagttatgaccctgatctcttgaagcggccccaaatcgtggtggcgactaagatggatatgccggatgccgaagctaatctggaagactttaaggcgaagttagcgacggatgatacgttgccaaacacgccagccgtctatccggtatcgtcgattacacaacagggactaaaagccttgttagccaagacggctgatttgttggatacgacgccacaattcccaatcaagggtgttgacgacttgaagcaccgtgattacacgactgaagcggatgcggactttagcattgataatccagaaccgggcttgttcgtcttgtctggtgataagttagaacggctctttaagatgaccaatttagatcatgaagaaagtttaatgcgctttgctcggcaattacgtgggatgggtgttgatgatgccttacgtgcagctggtgccaagaatgatgatacgattcaaatcttggactactccttccagtttatggactaaacttttgtgacgacataattagttgatgattgtcgttacgacagtctggtaggtagactagtgataaaataatgaacaatccaaaaacagcgccgttagaattttaactaacgacgctgtttttgagttgacgtgcgattagatgctcagccaaacagtaagcgctgctggcttaagcgatagccaaataatcggcgcggacgcggtggggtttgaatacagagctgcgtttgaccatcgatttggcgcgtccgcgcattgaactggtcgagtgtcagcgggagcgcgctttttgaagctactaaaaccagctggtgatcgacgagcgtaacactttggattggccagatttgattagtcgttagttcccaatacagtggtaaagtttgctgtagatcagcggttgataagttaaagtcgatgagtcgcataacggttacctcttgttcagacgatttgtaagcaagtatacgataatcaattgggttaagcaagatggactgaggattcatttgccggcgatgacgggttgaatgaaaacggtcacaacccgtcatagtcagtttgcccggaaaagtgcattttttgattatagataacaccggtggcaggcagtcttggcgcgtggaatcttgaaaccaagtgcgataattttagcctgacatgttaaaataaaatgagcagcgttgttcgtgttcttcctgttaattgtgaggagtcgcccaacgtcgcttgctttttagaattgcggtcggtgagcgcacggtgttgaccggccatgactttgcagtgctaacaattgtgtattgccgctagattcggtaaaatagttagcagactgtatagataggacgaacaaaaatatgcaattagaatttttaggtaccggtgccggctcaccgggcaaatttcgaaatgtcactagcacagcattacgactattagatgagcgaaatgaagtctggttgttcgatgtcggcgaagggacgcaacaccagattttacgcacgacgttaaaaccacgcaaaattgcaaaaatatttattacccatctgcatggcgaccatatctttggcttgccggggttattgagctcgcgttcttttcaaggcggggacgaaccactcaccatttatgggccagtcggtgtccgcgacttcgttcaaacggcgttgcgggtctctggcacccatttgtcatatccattgaagtttcatgaaatcacgaaggctgagacagtttttgaagatgcgacgttcaaagtaagctgcgaacctctggatcatcggatcgcttgttttggttaccgggtagaagaagcggaccacccgggtgaattacaagccgatcgactcaaagccctgaacattccgagtggtcccgtctatggtcaattaaaagccggcaaaacggtgacgttgcctgatggtcggacaattaatggtcaagattacatcgctgcgccacaaaaggggcggacggtgacgattctcggtgatactcggcggacaccgcacgcggtcagcttggcacaggatgcggatgctttagttcatgagagcacgttcggaaaagatgaaggtaagttggcacataactattaccattcaacgagtacccaagcagcccaggtggcccaacaggccggtgttaagcagctattgttgacccatatctcggctcggtacacgggtaagttgagtaaggaactacaaaaacaagcacagaaagtctttagtcactcgaaagtcgttcgtgactttgatgtaattgatattccattacctgagaaaggttaggtcaagtaaatgacgaacttagtgggtaaaactgttttggttactggcgcgtctagtggactaggcgagcaactagccctagccgtggcgagtcagggagccaatgttgtcttagcagcccggcggcgagaacggctaacacaggttgctgatcaatgtcgtctgttatcaaaggggcaggccgtggcgattacttgtgacgtgggccacgtggcggacgttgatcacgtctttgcgaccatcgatgagctatttggtcaattggatgtggtcattaacgccgctggttttggcgatatgaccacggtgatcactatggatgcgccggtaatggcgaaaatgttgcgcgtcaatacgttgggaaccatgtatgttagccaactggctgcgcaacggatggtcaagcaacatgcaggtgaaattgtcaacatcgcctcgatggctggcaaaatcgcaacacctaaatcagccgtttatgcggctagtaaggcggccattattgcttatgataatgcgttgcgcttagaactcaaggatgctcatgtcaacgtattgacggtcaatccgggtcccattaaaacggactttttcaaaattgcggatcccacggggcactatttagaccgggtcgaccagctggcattgaaccccgttaagtttgctgaattgattgtaagcaaactcgggcatcaacggcgcgaactgaatcggccttgggtgatgtctgcagctaatttaggttatcagctggcacccaagctcggggattggctgacggggacggtttttaattttaaataggggatgagtttaatgaagaatcaatggcggttagtgagtgcactagtcattgcactagtagtgattatttttgcaattttaaatgtagaaccagttcgaatcaattttggaattacagcagttcattggccactgattttggtcattgtggtgacgttgatcttaggtgtcattaccgcagtactgatggcgacggtcaatgaatctaaggaacggacagcccatagtgaagctttagcagcggcccaggctaagattgacaagttgactgccgaaaataagcaattaacgttgcgtttgaataataaaggtaaacaaaaacgagcggtggcagaacaaccaaccacgccagcggataagtaagttgttgaaaggaaggatgccatgttagcggcaaagaaaaagtgggtgccacggttaacaacggccattgatgaagccgatgttgataagttagctgaggcggccagcgtgacccctttagttgcccggttattaataatgcggggcattaatacggcggaagaagccgccccattcctgcacgcggatcaacaaccattgttggacccaacgaccatgcacgatatggaaaaagccgttgaccgcattcaagaggcgattattgccggggatcaaattaccatttacggtgattatgatgcagatggtttaacaagtacgtcaattatgtatgaaacgttggaccaaattggcgctaacgtgaattactatattccagatcgtttcaaggatggttatgggcctaatcaggccgcttttgaccggctgattgcggctggaacgaagctgtttgtgacggtggacaacggtgtcgcgggaaatgcggtcatcaatcaagtgcaggaacagggcatcgatgtcgtggtgaccgatcatcatgagttaccgactgaattgccgcacgcttacgccattgtccatccacgacatccagagggcagttatccatttggtggtctttctggtgccggtgtggcgtttaaagtagcgacggcgctacttgaggaagtacccgaggagctattagatctggctgctattggaacggttgctgatttggtcagcttaactggtgaaaatcggactttggtaacgctcggcctgaaggtcttacagcagacgacccgcccaggcttggccgcactgattcaagaagctggactgattcccgataaattgaccgagaccaatatcgggtttggtattgcccctcggctaaacgcacttggccgtctgcagtcggcgcagagcggtgtagaattattgacaactttggacgatgagcgggcgaccgcgctggccaaacaggtcaatcaattgaatgaaaaacgccaaggattggtcaagacaatcagtgccagtgcaatcgagcaagcacagacgtcggaaaatgaggcccgtcaaaccttagttattaccgggcatggttggcacgagggtgttttgggaatcgtcgcgagccacgtggtcgaaacgactggcaaaccaaccctagtgttaaatgaggatgatggtggccggctcaaaggtagtggccggagcgtcgaagcgtataatttatttgccgcgatcgacccagttcgggagtcattggtggcttttggcggtcatcatatggcggttggactaactgtcatggccgaccagttagcaacgcttaaagaggcgatggaagcggcggcgggtcagcaattagcagacaatgcgcaagtcagtttaccaattgacggcacgttaccattagctgaggcaaccttggcaactctggcagatattcaagcgttggccccctttggaacggataacccggcaccgttgtttgaattagttccaacgactgttccgcaagcacgcgcgattggtagtgatcagcaacacttgaaattacaactgggtgatggcaccaatacgattgatgctatcggtttttcgatgggtactgccttgccggctattcaggcgagtcccaccgatgtgacgttagtgggtgagttgagtgaaaatacttggaacggtcagacgaagccccaaatcatggttaaggatattgcagtgacggggacccaggtgatcgacgcccggacgcaacatctttcggcccatttgtttcaagcaccgggggtttacctctttttccaccagcgtctgttgaaaaaagttgaacagtatttaggttcccaagcgcaagccgtatgggtgggggatacgaaaacggatctgactgccgtgacggctaatcaagcggtcttcattgtcgattgtcctgacacgctggcggatatgacccaggtactcagcacaattgcgctcgatcagctgacgctctacttatatcggcaagaatcggtttatttaacgggaatgccaaatcgcgcgcagtttgcgaaacttttccagtttaccgcagcgcaccatgatgttgatattcatcatcaattaacattagtggccaagcatctgcatattgaacgaaatttgcttattttcatgattcaggtgttttttgaggtcggatttgttaaaataaatgatggtgtcatgaatggcgtttcgaatccggcaaaagcggatttacatcacgcccctagttatcagctgcgcgaacaacaaatcgttgctgaagaaacgcttttatatagtaaatctgcagcgctccaagtatgggtgaagaaccaggctgcggttaagaattgaaggagctgttaagaacaaatggcattagatttaaaaaagtatgtggctagtattccggactatcccgaacctggaatcatttttcgcgatatttcaccactgatggctgacggggaagcttaccgtgaagcgactgatcagatcgtgcaatttgcgcgtgataaacatgttgatatgattgtcgggcctgaagcacgcggctttatcgtgggttgtccagtggcctatgaattaggcgttggttttgcacctgctcgtaagaagggtaagttaccacgcgaaacggtcaaagcaacttatgatttggaatacgggcagtctgcactttatttgcataaagatgcaattaagccgggacaaaatgtgctagttactgatgatttattagcaactggtgggaccatctcagcaacgattcaaatggttgaagaattaggcggtaacgtggttgggacggctttcttggtcgaactcaaagagttgcacggccgcgataagattaaagattatgatatgttgagcttgatgcaattttaaagccaatattaaaagctccgaatgacgatttattagtcattcggagcttttttgctaacccttgttttggtcgttagttagcttggatagtcagtgattctttggtagccaagccaaaaagactaacaattgcatattctaattattgccacttttcaatgagtagtttaacctgacgcttgtccgttgactgaggatcaggatcattcttttcagcatcgccaagcaatttgatcaaatctaagcgcaactggtgctcgcctgccgctgaaaggtttaggatcgcgttactgaaaaaaatggctgacttgtcaggttgcttgcgggtcatctcttcctggtaggcttcggtaaagtcgtggttcaatagcatgatccattgtaaaacttgttggacatgggcttgagtccacgtaccggagatgtcagtcagatcagtatcgagaccatcaagatctgccaattcctgtggtgtctcatgggagaggtggtcactggaatagaagttttcagttagatttttaacctgaacttgattaacgatggttaataagtcggcatcctgcattttgttgatggtgtagtacaactgattgttgggaattttagtttgggccgaaatttgcttagttgttaaaccagttttagatttggtggcctttaagatagcggccaccttgggatcggccattaactttgcaaactgagccagtgtgtttttgggcatgtttttcacctcaatactagcttaaccatttgacaaatagaaatcaaacgattaaagttgctttatcatttaaatttatttaaacgataaataatattaaattggaagtggcgttatgaaaaatctaggccgtaatcgagcgtttgtcacgttaacagtagctgatctttttgagacaattggtaccagcctatttaacattattctattaacgtacgcgcgaacgtttgcacaagcaaatttgatggtttcactagtttcggtggctactgtgcttcctggtatttttggtatgcttactggtcgattggcagactcgcaaaccaataagcgggggtggttagcaggtttgaaatttgttcaagcggcattatatctcgtgttagcgcaacttattactgaaaaacaggtcgggttgctgttgattattattgtcatcaatttgtgttcagacgtgttggggatgttgagtggcagcctccgaatgccattattacaagctaaagtcgcgtctgagttacaagaagaggccttaggtatcaaccaaggcatcggagtgttaatgcagacgatgggccaagcgttaggtgtcagtctattggccgcaacgggcgattatcgtctcgcgggatatttgaatgcaatcacgttcttgattgccggtctggtgctactgtctgggtatgaaacgctaaaattaccttccgcaactgtcaccgtgacgtcgacatttcgtcaactgctacgacaagtgcgacaagcaatggaagcgggggtgcacatgaacgtcttggcgctattggggagcgtcttgttcttgaatgcggtgggtgcaagcgtcgatgcactattgaatttatacctgattcaccgggcgacgcagttaccattttcattcggagtcgcaattcttgtgatgaatactgctgacgtatttggatcggttgcagggaatttgttacatacaggttactttcagaggtggacgtttcgtggtgtcatgttaactaccgtcgtggcgtttgagggtttatttattaatctgttgttttggcaaaactattgggtagtggttacaatcatgatgattgggggattttgtatgggacaagcaaatcctaaattgatggcgagtttattgaaagtggccgatcaaagtatcgttgggagcttaggcggcatcataaattcattggcgacgatttcgattccaatcggaagtgttggattggtcttgttggataatatcgtgagcccagaagcggcttatttgacggccatgggattactgttagcttgtggtggttgtctgttcattcgccggtgacgaaaattataattgtgttatacaaacagctgccaccatgctaaaaaaccgcttgcccagattaccggcaggcggtttcgttagtctcgaatcagattaagcattgtcagtggtcaaatcttcggtgataaaacgaactgcggtaccatatgcggcaaccgattgcatatcctgactaatggagccggtgtcgaaccgcatcatcacaacggcatccgcacccatggcacttgcattatcgcgcaaccgattgaccgcgacatcgcgcgactcttcgagcatcttggtgtaatccttgatttcgccgccaactaggccctttaagcctgccccaatgttacggaccagattcttagattgagtggttaacccaaagacttcaccgataacttcataggggtgccccggaatattttcagtggtcgtgaccagtaattgtgtcattgactgaacctccttttaaagatattgtaatcatagcataattcgtattgaaataggccagcggagactttgatgagtggtctggtttacaggaaacgaaggaggcaaaatatgacagctttagaaagaagttggtttgaagaagcgcagcaatccatgcacggctgggactttagtcatctggctggccggtggcagactgcggacttaccgtgggattacgctgccctagttcgtgagcatctaagtgccgatgatcgatggttggatattgatacgggcggtggtgaattgatggggcgttttaaccatcagccagcgctgactgcggtgactgaggggtggcaaccaaatattgagttgttgaagcaaacggtggttaaaaaggggataacattatatccagatgccgccgaacagttgacggccgtaccaaattcgacatttgatattgtaacgaatagtcatggtgcgatgccagtgaagcgaattgcggaagttttaaagccggggggccgatttgtgactcagcaagttggtgcgaccaataattatgcgttgtcacgattctttgacgagcattacgaaacggcgtatcctgacaatcagttgttgacggtaatggctcaaatgcaggctgcgggatttgaaattctgcgggctgagcaagcctacgcggcactgagttttacggatgttggcgcaattgtctattatgccacggtgattccatgggagtttccgcattttgacgtggcacggatgcttcccaaattacatcagttacaatccttactggccattaatggtcgcgtcacgacgtttgaagaccgatttatgattatcgctcgtaaactggctcgtcgtgattgaggttgcgagggggcatattaatcggattggcacttaacaaacgtaatcggttatgaattgtaacttaaacgtcggatttgagtattcagagcttgtacctaattgcgcactgcctataataggcgttattccaatcggttatttcattggaatcacgagttaggggggagcgtcatgcggatacgtcgaccggttcggttttatcgttcattttggttttggttaagcgtgatttttctatgggtctcaactgccggttttccgaagactttagtgacagtgggggatgtactgtgctatggcattttatttttactatcatgcgtgggtattcttggttcgttctttgtttttggtcaagccgcacgtgaacagaagtaattgggtatccgttggcaagggctgacggatattttttgtggaaaattctgaataaatatttgttctgaaagctaattatgctatacttattaagtaccacatggagagttggcagagtggtaatgcaccggactcgaaatccggcgaaccggctaataccggcgcgcaggttcaaatcctgtactctccttaaatcattaaggaacaactttctttgaccccacaaatcgttgagatagcggggtttttgtttgcttcaaaacgcttaggaacgctctggattgatatattggtgcacttgtcggtgtactctaatgatttttaccctgtttttgggatgctttgagtgcaccacagtggtgattttttaattgctgggccccttgtgtcccaacggatacagcaatcttcataatgcacattaactaaatttagccagtgcatttaaagtccgtgattcttcctgtttttgatcttcagtgagcagatgggcgtacacattacgcgtgattgaactattcttgtgacccaagcgttttgaaatatactccattttgacaccacaataaagcagggaactcgcatgtgtgtgacgtagaccgtggaagctaatccgtttaatttcaagagtggtatgatagttctttagcaataaatcacaagccccaggagttggaatacgaccacgattatttaagaataccatgtgatcggggttatccagattcttttgaatctgtaatgatcggagctgttttaaatgttttaacaactcatcggtcacagaaattttacgaatactggactcaattttagtccgtttgaacttctgcccatacacatagtcccaggacttgttaatacgaatggtcttggttttccagtcaatatccgaccatgttagagcggacacttcagcgacacgcataccagtcattaagccggtatatatcatcgacttgccagtggaggttaaacggatgttcttgtttacctcattagcaagtattttcatatccttgacgtctagaaatttgagttgagcatccttacctttatgaccacccagttcagcatgagtacagaaatcggattttattaattcgtcagcaacggcatcaatcactgctgcatgaatgtgcccgtgaagtttttgaacggatgctttactatgataaggttggtcacctgttaaatgacgtttggcgcgttgttcgacattgccatgggtgaagtcattcaagaactgttgataccgggttcgagtcattgagttgagtttaatgttgccaagtaattctctaatttgacgcaaagtgtaacgatattcctgttcggtaatctgagccaatttgccaaacttataggtttcaagccagtgtgagtaataggcgtagaaggtggtagttgtatctactaaaccgatggagttattaaatttgtctaactctaaactattggcccacgcttcagcttcaactttacggctaaaaccattcttattcttaaagtgacgtttgccgaactcatcatagtaacttactcgtacttgccatttaccatttttcttattaatacttgccatttatatttcctccttaaatttcacctaggcgggtagaatttgaaggacttgttgtcatcacctttcttcaataaaatggtaaaaatttaatacgttattaggttaaggtcgtcttctttttggtgggaagatagtttttatataaaataaaagagcaactatttttttaaactggctactcctaatatgaactaataactgactgtcagcagtgcctagatcagcgaacggtcgaaccgtcttttccttattaataacaataatagttcacgcgttgtgttagttgattcctagcttgatcattgtatgaacaagtaaatattgctctaatcgtaactgtaaggccgtcaatgatcttacgcggattcattcaatatcaaataactcatttagttgtgaaaaatttgtctcactctggcgccgttgtcgatttagtaatcgttggtaagccacgggctgcttcatgtttcgacgaaccggcgtccataaattaatcttctttttggcaagttcttgtttgagcttacgactaagataacctaaatctaccaatatttgatggctaggccataacgataataatgtttgtactgatttaatagcatgccaggaagcgggggtcacatcgtaagttaaaacaatgccattattagcgacctcgaggttacctttgaagctgtaataataaagtttcttagttgcgttataatcgatattggcggtttcgcgaaagactttagcacgatgatttctaataccctaacataagggcatcggtaaactatcaataatcgtgtaagctggtgttggacataaattacgtaataccccaaagcaaatccattgaagttcattggcagcataataacacttacgattaaagcgtgatcgttctggcaattatccgggtttaaaaatatttcgttttaaaaaccggtagtaaagtgaaccctctgagtggagtaaatccagactcagggggttttactatggttcagctaaaataaagcaacgagctttaagtagatatctccagggaacttcgcccctgttacttatgaaaaagtatgatatcaaaggaagtgcgacgatttatcagtggctcgctcaatttgaaatttttggcattcaaggattagagaattgtcgtaggaagacattttatgactattcctttaaaatcaaggttattaaatggcgacaaaaacatcatgcctcatatccagtaacggcaacccatttcaggttgaagcaaccgatgatggtttgggactgggaacgaagactgattgagggacatcttaagccatctaaaggacggtctttaaaaatgacagataaatctaaacaatctaagacattgaaacaacttcaggaagaaaacgagcttttacgaatccgggtagcatacttggaaaaactcgaagccttggcacagaaagaatctcaaaccaagaaaaagcccagctaatcactgagctaagacgtaaattcaatgttaaattagttgtggttttaaaagcagcacacatgtcgagtagtaattaccacgatgcacttcactgtaaatatcaatcaggctcatcaacgttagttgatgagattaaaagcgttcgtttggccaatcccgattacggttaccgaaccgtgactttagcgcttaaaaataagggaatcaacgttaatcacaaggcagtacttcgtattatgcgtgaaaataatctcctttgtcaggcattcaatcgtcgaacgaagaaatataactcttataaaggaactgttggtacagttgctcataaccgtttaaaccgtcgttttaaaatggatcgcccatttcaaaaaatcgttactgatgtaacggaggtccgttgggggaatcaaacaatcaacaaacgtgcatactttacagtttatattgacctttataacggagaaattattgaataggccattggacgtaaaccaacggtagccttcgtcacacacccccttgaacgattagtggcaagacgttcaggcttaccataccgtatgataattcattcggatcaggggttcagtatcagaactgtcggtacgtgaatattttgcgacaagctcgcgttttccaaagcatgagccgcaaggccacatgcctagataatgcggtagctgaaagtatctttcacattcttaaagttggcacggttcacaattatcaatacaagaactatgaagagctagaatccgccattataaactacgtagattattacaatcagcgtcgtatcaaaacaaaattggtcggtatgtccccggtaaaatatcgggaatataccagccaattagcagcttagaaatttactccaatttatgggggtcacttcatagaacctagttcggacggtcatttttaaatcaacttgtcaacaaagtaatgataacaataagacgtctgaaagcttgccttgattgacgttacggcggttttgaatttgctcgcggactaatcacaaattggttatgataaaattggtctaacataagacacactcctttgtttgcgctgcttgaagtgtagcttggttaggcattttttcacaactaaagtcttggttaattaactagcacaatgcgtataggtatatatatctgatgattgcaaatgcggtgggttatattgttataattatagtggaaataaatttaatatccattagaacagtctccaatctgattcggccaaataattcacagtcctaaaatctgtctcttcttagcatcaaagtcgtcttgggtaatcacgccgtcatcaagcagttgtttcaattcgtgcaactcatcaacttcacttgagccgatgttagtggggacaatattggctgagttagctgcttgttctttggctttctgctgttcttgataattttcccaacgttgaattggatcaatgatagtattgctatctcgtaagtcttcaatctcttgcacagtaagtgtcttttcaactagtacatccttcgggagggcagtgtagtcaacaccaattttctgtaagcaatcagtacagactttaccattttgaatgtgcactaactcatcacttttgtgcttgttattgcagacgtcacatctattagcttttacaatgaaataaacaattactattaacgcaatagtaataatggtgattatccctggcgtactagatacaactcgccagatgaatgagaagatacctttaacaaggtagtagagataagtcaggactgctgcgagaacaacgtagggtgcagccttacccataagtttaaatgccccgactatgagcaagattaatagtagtaaccacatgttatttcccccttaattaaatcccaagaatttgtttcttttttgctgtgaattcttcttcagttaagataccatcatcaagaagtcccttgagtttgcgtagttgatcggcactgtcagtagcagagactggagttgcaggttcattaacgttgctattgttgttggcaataattgtatcaagatcatggcagaatctaagtaattcttgttgagtgatatggtaggcactgctatctgttttagtagtttcgttaagtaagactgcttccacgcgatggtcgcctttgaaataaagcacgacagagactttagaaacggcagcatacgatttattaccagaaaatgcgcctaatacagcaccagttggaccagcaattaaaccgccagctattgctcgagatagtccatgtttatcttcaatagtagtcccattttcaataggatcatatccttctaagtcactgtagtcatatagttggaatggttcatcagctaagttttccatgaaacttagcttaattaaaaattgtttgcgtttgtcactgagataaacttttccgatatgaccgttaccttcttttttgaaagtaatcagtaatttttcatattctgatttattgtcaaaaagcaattgtttggcatctatctgagtatgagagtcttgatgatttttgatatcttggacagttaaatatttgacagcggattgtgagctaaagttattttttaaaccaactcgagaagcacagtcgtcacaaattttcccatcagttaatttgaagccacctaataaacctatttcacgaccacaaaccgcacaggggtgtttgattttagtattagaatcctggtgagcagatacggttggtttgtttttcatatcatctaaatatttctttaaatctatctgggtattagtatcttgataatttttgatatcttggacagttaaatattcgacggcagattgtgagctaaagttattttttaaaccaactcgagaagcacagtcgtcacaaatttttccatcagttaatttgaagccacctaataaacctatttcacgaccacaaaccgcacaggggtgtttgattttagtattagaatcctggtgagcagatacggttggtttgtttttcatatcatctaaatatttctttaaatctatctgggtattagtatcttgataatttttgatatcttggacagttaaatattcgacggcagattgtgagctaaagttattttttaaaccaactcgagaagcacagtcgtcacaaatttttccatcagttaatttgaagccacctaataaacctatttcacgaccacaaaccgcacaggggtgtttgattttagtattagaatcctggtgagcagatacggttggtttgtttttcatatcatctaaatatttctttaaatctatctgggtattagtgtcttgataatttttgatatcttggacagttaaatattcgacggcagattgtgagctaaagttattttttaaaccaactcgagaagcacagtcgtcacaaatttttccatcagttaatttgaagccacctaataaacctatttcacgattacaaaccgcacaagggtgtttgattttagtgttagaatctttctgtgaaggctcagcaggtttgcttttcatatcgtctaaatactttgcgatgtctattttagtatgggagtcttgatagcttttaacatcatcaatagtcaaatctttggcgacggatatagactgcaggccagtttttaatccaatttgttctgagcagtcgacacacataatcccatcctttatgtcaagccgactagccatgagtccgattttctttccgcatatatcacattttttagccataattaaattcctccaaagttttatttcctaagtaaatatcttataaatctagtatttatcatacacagttaactaaaggatgaatgcaccttggctaattttaataccaagctcttgttcagcaacattatgaataaacagtgattagatccccagaatttgtttcttttttgctgcgaattcttcttcggttagaatgccatcgtccaggaggcttttaagtttacgtagctcatcggcactgttagtgggtgtagatagagtggtaggttcattattttcattttcgactaaaattttatccaatcgaacacagaatcgttgcattttttcttgttcatctcgatagtacatgctgtcgatttttgtttcagtggatatgtagtttaattgcttagagtagttgttattaaagtataaaactactgccatctttgaaactgcgtcataggacttgtttcctgaaaaagcacctaatacagcaccggtaggcccagcaactaagccaccgactatggaacgagacaaaccatgattcttgttaatagtggtagggctttcaattgtcttgtaactagttaaatctgaaaatctgaaaaggcgatagtcttcaagaatagttttatcaatgaagatttgctttttaacaaaatctaaatagactttaccttttttgacaggttcatctgctttaatggcagccttaagttgatcgtatttatctttttcagcagagatatcttctttttttaaattttttcttgttttaacttatttttatactccgcccagcgcttttgtggatcaataatttggttgttagcttgtaagtctttaatttctttaacagtcaaaatttcttctatagacattgaaagcggtagctcaacgtaatccacaccaattttcttcatacaatcgtggcagactttaccatcaatcacaggaacggacttaaacatttttaatttgtttccacaaacatcacattttttactcatagtaacttcctccaaatttttattttcaaagtaaatatcttataaatctagtatttatcatacatagtcactaaagtatgaatgtgccttggttaattttaataccaagctcttgttcagcaacattacgaataaacaataaatgttttgattctaaattgtaactgttagcaaaatgcaagatattgaaatcttgtggttcaatgccggtttcactggggtaatgatttaacataatatagaatgcaccacgattagcccgtgattcaatttttgtattggaaaccatgctagtatctatgtaatggttcaaccgtaggatcaagcaaacaatgctgtaattcatgacattttacgaaagtaggtgatgtgttttttcattgataaaaaaggtttgggtcaatggcaaagtatgttctgactttaaagtataagaaaagtgtttttagtaagattaagctacactgcgttctcggttgtcagtaccattgcaatcaatcttgtcacgaacttgtaagcggtaatccgcgtcgaattggcaactagggtcaataagcccgtgctgcaattaacttatttgacaataaattaagactaactgttattttacaagtatcaccatgtttacacaatgttatatgcgtatctttaaataaaaaaatctgctatacaataataaaattgaaagcagattaaaaatataagattttatcaagttagaagtgttcaattggtcatatcgttcccaaaattggtcttacttcttttcctgcacgatgtagtggggccggtgttttgattcgatataaatcttaccaatgtaattgccgataatccccagacagaacagctgaatgccaccgattaagagcataatcgtgatggttgaggcccaaccactgacactgttatcaaataatattttacgaataataacgacaaatatactgataatggagattagtgagagcaagccgccggtgaaggtcgcaatcttcaggggtacatctgagaagtcgacgatggcatccattgaataattgaataattgccaaattgaccagtgtgtctcgccagcggaacggggctgattttcgaacttcaaataagttgttcggaaaccgacccagttgaagatgccttttgaaaatcggttatattcaggcaattccaaaatagcatcaaccatctgacgtgtcattaaccggtaatcgcgggcgtttggaataatttgtacttttgaaattttgttgacaactgagtaaaacgagcgtgataagaatgaccggatcattggttcaccaacgcgattttcccgcattgtaccgatacagtcatagtcaccggtttgaagcattgccagcattttaggcaataaagtcggtggatcttgtagatcaacgtccatgacggcgacgtaatcgccaatggtgtgctccaggccggctaataaaccagcctccttaccaaaatttcgcgaaaaggagacatagtggacagtgtcaggatggacggcgtttaaagttcgtagtacgttcaaagtgtcgtcagatgagccatcattaacgaaaacatattcagtagtgatatccttgaacgactctggattatctgccaagactttttcaacggtgttataaaatatttcaatcgttggttcctcgttatagcatggaacaacaagactcatggttttcataataattgtatccgacctttttataatttttagattgatctattaattagggctcctactgattaataaagaaaggaattttaaaccagtatgaatatcatagcttgaattaaggtataaagcaatcaaatatcaaaccacaaaaattgtaatgatgtcacgatagcttgtcaattacatcaccaatcaagtacgtcgacagcgatgcgtcatgttatttcaaatttcacacctggcagtgttgagtagtttgcaaaaaacaactccaactgggcacagtagcatggcccgttgaagctgttggaaaagtgattattgtgatttatctttttgagattgggcgatgggtgtcaaggtggacttagaaatattcacaaccgtcaaatttatattttgacaaccgaaatgcccaattagcggatatgaatctatagccgtaaacagctaattatttgcgagcgaaacccaattagtggcctgaatggtatcaattcgatagacagcaatggtgacgtcttttaaggatccataaagtgtccctacaattgttaatggtgaaacggaatcgcccacgcgtacttgccaggtacacttgttgtggaagttcggccggtcgatacgcagttcaatatgttgattgctcagcgaattgataacgagacgcgagggtgacaggctaatgatatcaccatcaatcggggcattaatcaccggactggtcggttgtatggctaatagcccgatttgttggggtgatgtggcagtgggaatcaccgtataagtaccggcgacgggtgcctgaagactatttcgtttttgatgatgtgagaaccacatgtttaccgcgctccttacttggtgcttgtcttaatcgccttatttaataacagcataaattatggaacccgtcccaggtcaagcaattgcgggcagtatttttgtcgtgaaatgctataatagttaagaaatcttaggatggttaacgaacggggtggtcaagatggattttgtagaattgacaccgatcgcattggggcatacaccgcttggcacacgcggaccgaatccccatattcatgattggcaactcgattggcaaaaactaagtagtttgattgctgataatcaagacgtgatgatgcaggtggacgccggacttgctgaagattggttgaatacgcacggcaccatttgggacaatgtacaaggctatcaccgctacccgaatgacaaccgggcgtttgatgacaccgttttttgggcggcgtctacttgggcgacaccggcaattgttgtgacttttcataatgaaattagtcgggctttcagctgctatcgggtcggaactgaccctgattttcattactcagggccacgcggacgtgcatattaatcccttattgtcattaacaaattggaggaaaagacgtgaaagttggaatcgacaagttgcattttgcaacttcacatttatacgtagacatggcggaactggcgacagctcgccaggcagaacctgataagtatttgattggtattggtcagtctaaaatggcggtgattccgccgagtcaggatgcagtgacgttagctgctaatgctgccgcaccgatgctgacagcgactgacattgcggctattgatttattagtcgtcggtaccgagtcggggatcgacaattccaaagcgagtgcgatttacgtcgctaagttgctcggtttgagccagcgggttcgaacaattgaaatgaaagaagcctgctatgcggcgacggctggtgtccaactggcccaagatcacgtgcgtgttcatccagataaaaaggcgctggtcattggtagtgacgtggcacgctacggattgaacacaccgggcgagccaactcaaggtggtggggcggttgctatgttaattagtgcggatcctaaagtattagcactgggtactgagtcaagtctactgagcgaagatgtgatggacttttggcgaccattgtatcatacagaagccctagttgacggcaaatactcgtctaatatctatattgattattttcaagatgtgtttaagaattacttgcaaacgactcaaactagtctagacacactgacggccttagtttttcatttgccatatacaaagatgggacttaaagcgcttcgaagcgtgttaccattagttgatgctgagaaacaagcccagtggttgacgcacttcgaacatgcgcgtcagctgaatcgacaagttggtaacttgtatactggttcactctatttgagcttgttatcgcagttactgactgatcctcagttacaaccagggaaccgactcggattattcagttatggctcgggtgccgagggtgaattttataccggggttattcagccggattatcaggccggcttagatcatggtttaccacaacggttggctcgtcggcgccgagttagtgtggtggaatatgagaccttatttagtcatcaactgcaatggcgggctgatgatcagtcggtcagttatgctgatgatccccaccgattcgtattgaccggtcaaaaggacgaacaacgccaatatttggatcgacaagtttaaacgaaaaagtcacttgttactagcaaatatgctaggcaagtgacttttgttatttgaagttgttggtgatgatctggccatctttgacactcaacagcgtcttgtcagtggtatctggctgtagcaactgaatggtataaccagccgcaagatttttcttgagcgattttgacaatgatttgaaatttgaagtaatcgtcgtgattgctttttggttttgagatggatatgatttaatcgtcttcaaagacttaacgtattttttattggttggcgtaatcgtatacgttttcgttgacttggtgaatgcaacggtgccaattgattgataattggattgcaattgtttaaggatgttttcttcattcaacttagtggttgcggccgcgcgcttggtgctagcttcgttaaaaacaacttgtgaggaactcaagctcgttgatttggacttgctggtactagcgctagtactcgtgctagatgatgctttgcgcgtcgattgctgtgactggttgtatggccagtaaggcaatttaacgaccgcgtagatggtgaccagggcgctgaggaccgtaattagtgttagaaatttccaaccaccaccggtttgacgtgcgtaaatcacggaaaataatgctaatagaaaaacaatcaagcccataatggctaggaacaacatgtaaccaactcccaatgtttaaaatagtataatcattataccattgaactattggctgttcgtcacagatttgaaatattttgaaaagagatctgactaataaccaatttgacgccagcactttttctgtcgatacaccgggagaatcaggcgccgctggttcaatagcaatggtgctaccaccaaatcacagtaacgccacggtgggatagtgttgatgcctggcgcaaggtgcttgcagcgtatctctcagcgcacggttgtttacaacgagcgggatggtatatttgcgagctaccgataaataggtgcgacgagtaggtatcacgcttcgattaggcttgaaagagggcggattgccaatttacaaacggtgatactgacgaatcgggatgatgatgactcttttattcagaaggcaatcggttgggcatcacgggattatggcaaggtgaatccggaatgaggggcgtgcttttgtcacaaataacctgctctaaaaactggcgaataaaaaagatgacaaattgaattgtcatcttgtgggtgatagtttactgaaacagcatgtcgcgatataaaccgacaactttgcctaatacagagacgttgttcaagataattggggccatcgtgtcgttctcaggttgtagtcggtagtgatcggcctctttgaagaatcgcttgcaagtcgcttcattttcatcggtcatggcaatgatgatatcaccattgtcagcggaactttgacgccgaacaatgacttgatcaccattcatgataccgatattgatcatactttcgccacggatggtgagcatgaaaaggtcgccaccgaatgattcaagttccttaggaattggaaaataatccgtcgcttcctgtacggcaagaattggttggccggcggttaccgttccaagtaccggaatttgatgtggcgtagtttcgacgcccagtgcttcgaaaccggctggcgttacctcaatggcacgtggcttagttgggtctttttggatgtaaccttttttttctagtcgtgaaatgtggccgtgaacggtcgaagtcgaagataagtcaacggcttcaccaatctcacgaacggttggcgggtatcctttttcattgacacgttcataaataaagcgaagaacggccatttgtttgctttccgatgttttactcatcttggcacctcattttttattttcattattggttaaaccaattgtagcatagcgtttcatagctttcaaacaaatgttcggttgacaaacactattaattgatttagggtctaatttcgtgtatatttcaagagtgaaaggggctgctgatttgatttcaaaagaattgcttgctcggatcaatgagttagctcataaggcgaaagccgaggggctcaccgagctagaagaagccgaacgtcaagagttgcggcaaaaatacttgaaggaatttcgcgccggttttcggcaacaagttgaaatgcttcaggtttatgataaagatggtaaagaggttacgccagaaaaggtccgtcaagtgcaacgcgatcgcggtcttcgagatgattaaccgatttcaggaaaatttgtcaactgacaaattttccttttcttttattattaatttgtgtagactagtttaatgaagactgtaataagggaggggaatgactgtgtctacaggaatttggattttaatcgtcgttatcggcgtattggttgggttaactggtggtttcttcggtgcccggcactatatgcaaaattacttgaagcaaaatccaccaattagtgaagagatgcttcgtagtatgatgatgcaaatgggtcaacgcccatccgaaaagaagttacatcagatgttgaattcgatgaaagctgcatctaaaaacgataacaagtagtaaaaagtgtcggctcgctttaaattgcgatcaccgacacttttttattatcgaacttaatgtttctgacgggttgtagcaggatcaacgtatttgaacgttgggtcgatttgacgatccaagtcgtcaaaagcgtgcaacattttagtctcaatttgtttttgaccagcttcatccaatttcagtttacgatcaatatcaatcggttgaccgaaacggacggtaacccgctgacggctaaagagttgtttgaaggtcaatgggccttggtaaacggttgggactagtggaacaccagccatcttagcgatgacggttgcaccgcccttaagttcttgtgagtggcgcgttcctgatggaaacatgattagtgaaagcttaccgctgcgcaaaaatttgacgggggtcttgattgctgaaggtcctggatgttgccgattgacaggaaaggcgttcgcatgaacgagaatgaaccgcagaacgggattcttaaatagttcttccttggccataaagctaaatttcattggactgccagccagtgcatagtacaacgggtcaaaccacgtgcggtgtggcccaactaagatataggccccctctggtaggttttcccgtccttgatagcggggccgaccgttaataatggtgatgattagccggactagtccgcgcataaatgaataaaacatcacgatcttcctttcgtttaataactgctcacagtatgacgaaatttggcaaattctgcaagttaattgtatgatagctgtgcgacgaattgaatggagaggtggccgaatatggcagacgtcacgttacacgccgatgagcgtattgatcaattatatagtcaagatattcaaatcattcaaagttcccaagtctttgcgttctcactggacgcggttttattgggtgactttgcccaggttgcgaagggtgctaagagccagattgtggatctctgtgctggcaatggcgcagtaggtctattcgccagtgccaaaactcaaggtcatattacggcggtcgaaatccagccccggttggctgagatggcccaacgcagtgttattttgaacgatttaacccagcaaatgacagttctgaacgaagacttattggcaattacgcaccaattaccgaaggattcggtggataccgtcttgtgtaacccgccgtattttaaagatcaaccgcagagtgtcaaaaatccaaatcctcatttggcgattgcccgccatgaattgtccgctaatttagatcagattctagcggtaactagtgatttgttgaaaatgaatggtaaagcctattttgtgcaccgtcctgaacgtttggatgatttattcagtgcgatggcggccaatcggttggcacccaaacggatgcggttcgtccacccgaaagcacaacgggaagcaaacatggttctaatcgaaatgatcaaggacgggaaacgcaacggtgttcgaatcatgccgccgcttgtcgtttatcgtgatgatggtgaatacggggaagaggtgcacacgttactctatggcaagcacaagtaagccggctgcgtccacgacggcaatcaaaaaatattatttttatgtactattatgtgctgatcaaacgttgtatggtggttttacggataacttgcagcgacgattagcaacgcacaatgcgggcaaaggggctaaatatacgcgggtcagatcacggcggcctttgcaattaatttatcatgaaactttcactgacaaatcaagtgcgttaaaggctgaatatgccttcaaacaccaatcgcgagctgccaagctaaaatacttgtcagctcacgatgtgaaaatttagcgaagttttcacaatttatgattctatttctcgcatttactgttataatatttactgtatcaatatataggaggaatttttgtaatgaaaattattgcatatgctgtacgtgatgacgaacgtccattcttcgatacttggatgaaagaaaacccagatgttgaagttaaattagttccagaattacttactgaagacaacgttgacttagctaaaggcttcgacggtgccgatgtataccaacaaaaggactatactgctgaagtattgaacaagttagccgacgaaggggttaagaacatctctcttcgtaacgttggtgttgataacttggacgttcctactgttaaagcacgtggcttaaacatttctaacgtacctgcatactcaccaaatgcgattgctgaattatcagtaacgcaattgatgcaattattacgtcaaaccccattgttcaacaagaagttagctaagcaagacttccgttgggcaccagatattgccaaggaattaaacaccatgactgttggtgttatcggtactggtcggattggccgtgctgccatcgatattttcaaaggcttcggcgctaaggttatcggttacgatgtttaccggaatgctgaacttgaaaaggaaggcatgtacgttgacaccttggacgaattatacgcccaagctgatgttatcacgttacacgttcctgcattgaaggataactaccacatgttgaatgcggatgccttcagcaagatgaaagatggcgcctacatcttgaactttgctcgtgggacactcatcgattcagaagacttgatcaaagccttagacagtggcaaagttgccggtgccgctcttgatacgtatgaatacgaaactaagatcttcaacaaagaccttgaaggtcaaacgattgatgacaaggtcttcatgaacttgttcaaccgcgacaatgttttgattacaccacatacggctttctacactgaaactgccgttcacaacatggtgcacgtttcaatgaacagtaacaaacaattcatcgaaactggtaaagctgatacgcaagttaagtttgactaatctcgattatcactgaaaatggcgtcactcatctgagtgacgccattttttatactttcatctaatggggccttttcgaagcgttaaccccaagcgtactttcaatgctgttattatccataacaaaaagcccacaatcgagctggttgcacgactgtgggcttcacaagtaagcgattttgttagcgataacacaattaagtgttgctaggtaaaggtcttgctagcacgtacttaccgtggttgttaccagcataagttgctcgtagctttaacgccagtatgcgtctatgaagcgctggcggcttgaagaagtgctagcaatagttcatttagttccgctggactctggatgatttgatcaggaattacgctcggtgtcacctggtcattgcgccggtgattaaaccaaaaagtttgccacccagcgtgtttggcactggtcatgtcgagtgctgcattgtcaccaacgtaaacggcttcgttggccttgatgccaacctgatgggcccacgtcgtgaaaatcgatgggtcgggtttagcaatacccaattcttctgagataaagatgttatccggatgcacgaaatgttcaatttgtaattgatgtaacttttgatgctgaatcggcgctggcccgttggtaatgataccaattttaaatgcgtgactgagcttggtcagcgtcgcactcagcccatcgaaaaggcaaatctgatttagttcctgctgataggccatttcaaattggatagcccgatcagtgctgatgtggactttgctgggtgctaacgcgtgtcgaatacgggcggtttgccacgcttccagcgtcatagttgtatcagtgacctggttaaaggtacggtcattaaaatcatggaaccggttaaaaatttgtgccaattcagtgctgctcaaagcctggttaaaagttttagttaaggcagcagtgaacggtgatttttgatcatacaacgtatcgtcaaggtcaaaaatgatggcttttatcattattaagtgagccccctatgcgagattgtattttaacacactttcaggaattcacaaattcttgatgaaattgcttgcaagcactagtaattttcggtatactaattttcggtgttaaaaccaattcacacctactgcgataatcatggcggtgctcgggagagtgccatgattagttgaacggtggggaggaataaaacaaattttttggaggcacatttattatggctgttatttctatgaaacaattgcttgaagccggtgtccatttcggtcaccaaactcgtcgttggaacccaaagatgaaaccatacatctttacggaacggaacggcatctacatcattgacttacaaaagacggtcaagatgatcgactcagcttacaacttcgttaaggatgctgcggctgatgatggtgttatcttgtttgttgggactaagaaacaagcccaagattcaatcgaagaagaagcaacccgtgcaggtcaatactacgttaaccatcgttggttaggtgggactttgactaactggaacaccatccaaacacggatcaagcgtcttaaagacttgaagaagatggaagctgatggcaccttcgaacggttacctaagaaggaagtttcattattaatgaagcaacgtgccaagcttgaaaagttcttgggcggtatcgaagacatgcctcggattccagatgtaatcttcatcgttgatcctcgtaaggaacaaatcgccgttaaggaagctcaaaaattgaacattccgatcgttgcgatggttgatacgaacactgatccagatgacatcgacgttattattccttcaaacgatgacgcaatccgtgccgttcgtttgatcacttctaagatggctgatgctgtcattgaaggtcgtcaaggtgaagacgaagatgttactgaagattctttcaaggacaacaaggacgctaagaagtccgttgactcattggaagacatcgttgaagctgttgaaggcgacaacgacgccaagtctgacaaataattaattgaaataattaggctgcctaaaaatcgcggaccattacggcctgattttgcgggcagctttttatctaaaatcaagatactcaaaggagagtaaactatggcaaagatttctgcagcacaagttaaagaacttcgtgataaaaccggtgttggtatgatggacgctaaaaaggcgttagttgaaactgaaggcgacatggaaaaagccgttgacgttttacgtgaaaaaggggttgctaaggccgaaaagaagagtggccgggttgctgccgaagggattgctgctgttgcaatcaaggacaacaaagctgccattgttgaaatcaactgtgaaactgattcagttgcttcaactgacaagttcaaaaacttggtaactgaagttgccgacaagatcgctgaagaagaaccagcttccgttgacgacgccttagctttgaagacggctaacgggacggttaaagatgacgtcatcgaaacgactcaagtaactggtgaaaagatcagtcttcgtcgtttccaagttgttgaaaagggtgctgaccaaagttttggttcatacatccacaacggtggccaaattgcagccttagttgtcttagacggtgctgacagtgctactgctaaggacgttgccatgcacgtcgctgctatcaatcctgagtatgttaaccgtgaacaagttcctgctgaccggttagctcatgaaaaagacgtgcttgttaaggaagccttgaatgaaggtaaacctgaaaagatcgttgaaaagatggttgaaggccgtttaaacaagtggctttcagaaatcagcttggatgaccaagaattcgttaaggattctgatcaaactgttgcgcactttgtcgaatcaaagggtggcaaggttagctcattcattcgttttgaagttggcgaaggaatcgaaaagaaggctgataacttcatcgatgaagttatgaaccaaattaaagactaattactgactaagggattagctaattggggattacgacggaaagcaattttcggcgtagtccctttttgtaaagtaacgggttgaagccgctttaaaaagagaattcggttaatttttgcgccggattacggctggataccaaacgcttattgaaatatatggtaaaatgatagacagataatttcgaggaggacaaaacgatgtcggaagttaaatataagcgtgtaatcctaaaactgagtggggaagccttagctggtgagaagggctttggaatcaatccccccgtcattaaaacggtggcagaggaacttaaggacgtctatgacatgggcgtacaaattgcaatcgtcgttggtggtggcaatatgtggcgtggcgaagctggtgcccagatgggtatggaacgggcccaagctgattatatcggcatgttagcaacgattatgaatgccttggcactccaggataatctcgaatcaattggtgtgccgacccgggttcaaacatccattgaaatgcgacaaatcgcggaaccatacattcggcggaaggcaatgcgccatcttgaaaaacgccggatcgttatttttgccggtggtaccgggagtccatacttctcaacggatacgaccgccgcattacgggccgctgaaattaatgcggatgcgattttgatggccaaaaatggcgtcgatggtgtttactcggctgatcctaacaaggatgctagtgcagttaaatttgatacgcttacccatctcgacattatcaacaaagggttacaagtgatggatactacggcaagttccttatcgatggataatgacattcctgtcgtggtctttaacttgaatgaacctggaaacattcggaaagtcgtcgccggtgaacacatcgggacaacagtcagggggaaataatatggcaattacggaaccaattttaaaagaagcacaggaacggatgaagaaggcggaagctgctttacaacgcgagctcggtaatattcgggctggccgggctaacgcatcattattgaatcggatttctgcagattattacggtgcgcaaacaccacttaatcagatggcggcaattacagtacccgaaccacgggtcttaatggtgaccccatttgataagagtgcccttaaagaaatcgaaaaagctattttagcgtcagacctcggtattagcccagctaacgacggttctgcgattcggttagttattccacaattaacggaagaacggcgtaaagaacttgccaaggacgttaaggcggaaggtgaacgtgccaaggtcgccgttcgaaacgtgcgtcgtgatgcaatggaagccttgaagaagggccataaagatggtcaattcactgacgaccagttacatcagttagaagaccaagcccaaaagttaacggatcaagcgggtaaggacgtcgacgcaatcgttgcggacaaagaaaaagaaattttggaaggttaatgaccgaccaatttattaaggcttggagaaattcaagcctttttttgttgacgaatagttaattagtgctttttttggtaaaatagtgcatagttaagctatttttatggaggtgcgccttgttcgctttttttaataagaatgatcctgcagataacaccgacgtgcaattggatcctgaacgtattccagcccatgtcgccattattatggatggcaatggtcgttgggccaaagcacggcatttaccacgggttgctggccataaggaaggtatgaacacggtcaaaaagattacgattgccgcaagtgatttgggcgttaaagtcctgacgctttacgcgttttcaaccgaaaattggaagcggccaactgatgaggttaattacctcatgcagctgcccgtgagtttctttgatactttcgtaccggacttgataaaaaataatgtgcgggtgcaagtcatgggctacgttgatcacttgccagaagcaacgcaaacagcagtccaaaatgcgattgcagataccaaagattgtgatgggatggtgttgaactttgctctcaactatggttcacgggccgaaatcgtgaccggggtgcaaaaaattgcccagcaagtgcaagatggtcaattggcggttggtgatatcgatgatgcaaccatcgacgcagcactgatgacggcaccacttgcgccatacaatgatccagatttgttgattcgcacgagtggtgaagaacgcatttcaaatttcttaatgtggcagattgcctacagtgaactggtctttactgatgtgaagtggccggatttcacagcggcgacccttcaagcctgtatcgcggattttcagagccgtgatcggcgctttggtgggttgtcggatcataaataaaagggagtttttggtatgagacaacgagtcattacggctgtcgttgcgttaattttatttatcccagtcatttttgtgggcggggtaaccttagatattgtggccatgctgttaggggccgttgcgatgagcgagttactcgtgatgcgtaaaaaattattgatttcatttgaagcaatcgtaagcatgcttgcagttatgattcaaattgcaccgaataactggttcaatggcttaccagaccaattaaacaaggagtacgtggtttacttcttagttatcttgctactgttacacactgtgtggtcgcggaatcgcttttcatttgatgatgccggaatgttgacgttaggcgtcctgtacatcgggatgggcttcaactacttcacggctgcgcggggtgtcagtgtttacatgttactcttcctgatgttcattgtctggctgacagatagtggggcttacatggtcggacgcaaactgggtcggcataaagtcacaccgatcagccccaataaaacatgggaaggttgtattgggggtagcgtgattggtgtgatcgttgccagtgcctttgcaattgggtttcacgtcggctatgctagcgtcatcagtatggtactgattactttagtcttatcagtagttggccagtttggcgatttagtagaatccgcgttgaagcgttactatggtgttaaggattctggtaagatcttgccgggacatggcggtatcctagatcgatttgatagtatgttattagtttttccaattgcacatttattcggcctcttttaagctgagtacccgaaacgcgggagaaaggagcgcttaattgatcgttacaattattacgttcattatcgttttcggaatcttggtcatcgtccatgaatttgggcacttttactttgccaaaaaggctgggattctagtgcgtgaattttctgtcgggatggggcccaaggcggtcgcgtttcgtcgtaatgcaacaacttatacgttacggtttctgccaatcggtggttacgtacggatggccggggtggccgatgatgaagatgaagaactcaagcccggaacgccagttagtttgcaaattggtccggatggtattgttcattcaatcaatgctagtaagaagacaacgttgttcaatggaattccactgtcagtgacggcgactgatctcgaaaaagaactctggatcgaaggttatgagaacggggacgaaagtgaagttaaacactacgccgtcgatcatgacgctacgatcgttgaaagcgatggtaccgaagttcaaattgcaccggtcgacgtccaatttcaatcggccaagttatggcaacgaatgttgacgaattttgccggaccgatgaataacttcattttggccatcattacatttgcaattcttgcctttatgcagggtggtgttacgagtacaacgacccacgtagcggcgacgacagcagactcagttgcccgtacggccggtattcaaaagggcgatcaaatcgtggcggttaacggtaaaaaaatgacgagtgcccaatcgatttcgctgttgattcaagacagcccgaagcaacggttgactttgaccatcaaccgggccggtcagactaaaaaaattgcggttacccctgctgccaagacggtctctggtaatcgaatcggtcaaatcggggtccaatgggcgactaagaccgacacgagcctgggggccaagttagcatacggctttactggttcgtggggaattaccaaacaaatttttcaagtgcttggtcggatggtcactcacgggttcagtttgaacgatttaggtgggccggtggcaatctttgccacgacctcgcaagccgctaagtccggggtgcgcacggtgatatatttgctcgccgtgctgtcgatcaaccttggaattgttaatttattaccgattccagcacttgatggtggtaaactattattaaacattgttgaaggcattcggggtaaaccactacgggtggaaacggaaagtgtcattaccttgattggttttggcctcctgatgttattaatgattctagtaacttggaatgatattcagcgatatttcttctaagtgatatttaatttggaacaataaggagaagatttgtagatgaaacagtcgaaattgttaatcccaacactcaaggaagtgcctaatgatgccgaagccttgagtcatcaaatgatgttacgggcgggctatatccgacaaatttcagccggaatgtacgcttatttgccattggcttaccgcgtattgacgaatattgaaaaaatcattcggcaagaaatggaaaaaattgatgcagcggaaatgctggtaccagcagtcattccagctgagttgtggaaagcaactgggcgttatgagacatacggtccagaactattcaagctgaagaaccgccatgaccgagaatttatccttggccccacgcacgaagaaacatttacgtcaattgttcgcgatgaaatcaaatcgtataaacggttgccattgactttgtatcaaatccaggctaagtatcgtgatgaagatcggccacgttatgggttacttcgtgggcgtgagttcatcatgaaggatgcctattcatttcacgcggatgaggcctcattagatgacacgttccaagatatggcgcaagcttatcagaatatttttgagcgggtcggcttgaagtttcgttcaatcattggtgatggtggggcgatgggtggaaaggattcccgtgaatattcggccatcgcaccggttggtgaagatacaattgtttattcggatgcgagtgattatgcggctaatcttgaaatggctcggagtttatacgtcccaaagaagtcacatgcttcgttaaaggatatggaaaagatcgatactcccggagtgggcacgatcgacgaactggctgagttcttaaaagttggtgctgaccaactggttaagagtattctgtttattgcagacgatcagccagtaatggcactggttcgtggcgatcatgaagtcaacgatgttaagttgaagaattaccttggtgcggatttcttggaaatggctacgccagaacaagcccaacaatatttgggcgctagctttggttcactcggcccagttaacgttcatgatgacgttaaaattgtcgctgaccagtatgtgaaggacatggtcaacattacggtcggggctaacgaagacggtcatcacttcacgaacgtcaaccctgaacgtgatttccacgcggaagcttacgttgacattcgctttgttcaggaaggtgagttatcaccagatggtgcgggcgtcttgaagttcaccaagggtatcgaaattggacatattttcaaacttggcacccgttattctaaagacttgcacgcagaagtcttggatgccaatggacgtaatattccggtaattatgggctgctatgggattggtgtctcacggttgttgtctgccatcgctgaacaacgcgctgatgaaaatgggttgatttggccaaaagcaattgcaccatttgatgtgcacgtgattccggttaacccgaagaaagcggaccaggttgaggttgccgaccaagttgaagcacaattagaagccgctgggtacaacgttttgtatgatgatcggaaggaacgtcctggtgtgaagtttgctgattccgacttaatgggcattcctgctcggattaccattgggaaaaaggccagcgaaggaatcgtcgagatcaagcttcgccagactggtgagactttggaagttaaacaggaagaaatcgccaacaacttggccgttctgctcaagaatatcgattaaaatgctgcaaaactaagttaataaaaatatggcaactaccagttgatagtcgccaacaacaatcacctggttagattccgttgactgggtgatttttgtttgccgattaatcacgtggctcaacggtcagactgtgataaaatagtaacgtttcaagtgaacgatttgtgcgttcactgaagattatttcagatgccgttaatcgccgaggcatcacggtctcggttaagcaaactgacaaagtagtgccaactgtggaccgcggccctgagcacttaattggggttctagttaatattaaaagtcttgcttggcgttgggttagttgttagcgactaagtcatcgttgaaacgggattctgtttctagtgggtcacggttagcagcttttgattttaagattggatttgctttaatatatatgcaagcgcaaattaacaagtacggtgcgtgtcttactaactgattgtaatcaacaaaaggaggaccactggtgagtttaaaccaacaagaaatgttcgagaagttactcgaacaaattgaaatgccaacgggtcctgaatttacagaagcagcgatcgataaattgaccgttcatcaagcttccaaggtttgggaatttcatttgcatttccaacatgttttaccttatacacaatttatgacttttcaaaacaaactccaaatcgcctttaaagaaattgcacgcgtgacctttacgatcgtgactgatgataccgaggtcaatggtcgtgaactagctgaatactgggaatggatcgttcagcacagtgggatcaagtcgcccctggtccaatcattgtgtaacagcaacgtgccgacttatgaagatggtcgggtcattttgttggctgaaaatgaagttattcaaaattttctaactaaccaagcattagggccgattgagagtacctatcatcgcttgggcttcccgaagttctccgtccacacgatgattgatgagagtgcttcacaggcgaagatcaaggaatttcatgaacaaaaagcgaagtctgatcaagcgctggctcaaaaagcggaagcggctatcaaaaaggccaatgagaaacggcaaaagcaggcggatgcaccagcaccaattgatggtcctgtccaattaggcaagcagatcaacccgcaagagccggctaaacagatggtccaaattactgaagaagaacggtcggtcgtcgtggaaggctatgtcttcgatatggaagtgcggacgttgcgttcccagcggcagttattgattctaaaggtgaccgactatagttcgtcaatggtcgtcaagaagttctcacggaatgctgatgacgaggcacaattcgcggcactgaagcctggaatgtgggtacgtgtacgtggttctgtgcaggaagatagttttatgcgcgatttaacgatcaatgcgtatgatattaacgaaacgtcgcatgccagtcggcaagacacggcgccggcagatgagaagcgggttgaattgcacttgcattctaatatgagtcagatggatgcaaccaacagtgtcagtgattatgtcaaacaagccgctaaatggggccatccggcgattgcgattacggatcattcgggggcacaggcgttcccagaagcgtttgcggctggtgaaaaaaataatatcaaaattttatacggtgtcgaagctaacatggttgatgacggggtgccgattgcttataatgacgcccacgttgatttgaaagagtccacctacgttatttttgatactgaaacaacggggttgtccgccatttatgaccgggtcatcgaattgtcagcggttaagatggtcaaggggaacgtcgttgatcagtttgaggaatttattgaccctggttttcacttgtcggaaacaaccactaatttgacgagtatcaccgatgatatggtgcggggctctaaatcggaagaagaagtgtttaaacttttccgcgaattttatggtgatgcaatcgtggtcggtcataacgtcacctttgatattggctttatgaatacgggctatgcccggcatcacatggggccgattacaaatccaattattgatacgttgacgctggcgcggtggctgtatccgaatttacgcgggtaccgcttaaacaccctagccaaaaaattcaacgttaatttggagcaccatcaccgtgccatctatgatgctgagacgactggtcatttgaaccacctgtttttgaaagatgcggaggaccgttatcaggttcaattccacgatcagctgaatgatcatatgaatgaaaatgcggcataccgccatgcccggccatttcatgcgacattgtatgcgcaaacccaagcggggttgaaaaatctcttccgaattatttccttgtcgaatgttgagtactattaccgcgtgccccgtgtaccccgcagtgttttaaacaagtatcgggatggcatcctggtcggttcggcttgttctagtggtgaagtctttactgcaatgatgcaaaaggggaaggaagaggcccgacaaaaggccggctactatgacttcctggaagtacaaccgaaaccggcatattcggcgctgatcgagagtggtttgattgctgatacggatcacttggaagaaattatcagcaacatggtggaactaggccatgagatgaatatcccggttgctgctacgggggatgtgcattatctgaatcctgaggataagatttatcgtaagattttgattcattcacagcccggtaacccgttaaatcggactgaacggccagacgtgcattttcgctcaacggatgagatgcttaaagatttcgatttcttaggtacggagacggcacacgaggtcgtggttgacacgccccgcgcgcttgctgaccaatttgaaatcgtgcgaccagtcaaggataagttgtatactccgcggatgaagggtgccgaagcggaaatcgaaaaactgacgatggatcgtgcccatgcgtggtacggtaatccgttgccagaaatcgtccaaaaacgagtggataaagaactcaagagtatcatcggtaacgggttctcggtcatttacttaattgcccaacgcctagtatttaagagtaataaagatggttacttggttgggtctcgggggtcagtcggttcgagtatcgtagcgacgctgtctgggattactgaagtgaacccgatgccaccgcattatcggtgtccaaattgtcagtactcgcacttttatacgaataacgagtatggatcgggctatgatttaccacctaaggattgccctgaatgtgggactgacatggtgcgtgatgggcaaaacattcccttcgaaacgttcttaggattttatgggaacaaggtgccggatattgatttgaacttctctggggactaccaacccattgcccataattacaccaaagttttgttcggtgagaaaaatgtgtaccgagccgggacaattggaacggtcgctgataagactggttatggttatgtcaaggcgtatgaacgggatacgaatcaaacacttcgttcggcggaagttgaccgattagcaaagggaacgactggcgtcaaacggacgactgggcaacatccggccggtattatcgttgtgccggattacatggatatttatgatttcacgcccgtccagtatccggctgatgatcagagtgcggcctggcaaacgacccactttgatttccattcgattcatgataatattttgaaaattgatattctgggacatgatgatccgacgatgattcggatgttacaagatttgtcgggtgtccaacctgagagtattccaccagttgatccgcacgtcatgaagattttctccagtcctgaagttttaggagtcacagaagaccagattttctcgaaaacggggacgctgggaattccagaatttgggacgcggtttgtccgtgggatgctcgaagagactcacccatccacgtttaacgaattacttcagatttcaggactttcacacgggactgacgtgtggttaggaaatgctgaagaattgatcaaggatggcacggttacgctggccgaagttattggttgtcgtgataacatcatgaccgacttgattcactacggcatggaatctgatatgtctttccaaattatggaacacgtgcggaagggtcgggggatcccggatgaatggcaacaagcaatgaaggatgccaacgttcccgactggtacattgaatcttgtctaaagatcaagtatatgttcccgcgggcccatgcggcagcctatatcttaatggcgttgcgggtggcttactttaaagtgtacttcccgttgatttattacacggcttatttctcagtccgtgctgacgattttgacctggttgcgatggcccatggtaaagatgctgtcaaagcgtcaatgaaggcgatcactgacaaagggatggatgctagcgccaaggagaaaaacttactgaccgttttagagttagccaacgaaatgttggagcggggctttaaattctccatggtcgaccttgacaaatctgatgcttcggattggctgatcgatggtgatacgttgattgcgccgttccgagcagttccggggttagggttgaacgttgccaagcaaatcgttgctgcccgagcggacaagccgttcctgtcgaaggaagacctgtctaagcgtggaaaagtgtcgaagagtttgatcgactttatgactgaaaatggtgtgttaagtgatttgccagatgaaaaccaactctcgttgttctagaaaacacgacaattgttaaagtttgatgaatttttgcggtggttgatgcagttaacagcactcagacagatttatctgatttagggcctgtaatgttgatacaccggcaattgtcaggctgttgaagcggaagtttactgtgacttgaaagctaacggctaaatgctataaatggcgtaaacttgcggtttcaacataattgtgctaatatatgggttgtaatttaaaactcgttaacgagtgagcagcgatgctcactctttttattggactaatctgaataggaggcgcagccttgagtagtaatgttgttgaaaccattcagccagtggccgcagccattgtcagtgctcaccagtttgaactcgtggatcttgaatttgttcgcgagggtcaaagctggtatttgcgattatacattgacaaaccgggcggcattaatattgaagaatgtgcaatggttagtgatgaacttagtgaaaagctagatgcgatggagcctgatcccattccccaagcttactttttggaagtttcttctcctggtgcggaacgcccattgaagaaggaagcagattttcaaaatgctattggtaagtacgtgcacattggcttataccagaagttggatggcaagaaaatttttgaaggtgatttgacggcggtgacgccgaccactttgaccatcgattacttggataagacacgtcacaagacggtgacgatcaaccgagaacaaatctcacaagcccgcttagcggtaaagttctaaataagtaaaggagtctacacatgagcaaggaattattaggggccttagacaccctcgaatcagaaaagggcattaaaaaagaagttgtcatcgaagccttagaagcggcactcgtttcagcctataagcgtaattatggccaggctcaaaacgttgaagttgactttgaccaaattaagggtaatattcacgtttatgccgttaaagaagtggttgaagacgtctttgattcacgtttagaagttagtttgcaagatgcattggctatcaaccgagcctacgaaatcggtgatgatattcgatttgaagtaacaccgaagaacttcggccgaattgcagcgcagacggctaagcaggtcatcatgcaacgagttcgtgaagcagaacgtggcattatttatgacgaatacagccagtatgaaaatgaaatcgtcactggtgaagttgagcgccaagataaccggtttgtctacgttagtttgggcaaagtagaagcggtcatgggtcgttctgatcagttacctggtgaagtttatcggattcatgacaaaattaaggtttacgtctcaaaagttgaaaacgcaacgaagggcccccaagtattcgtttcgcggactgcaccagatttgttgaaacgtttgtttgaacaagaagttcctgaaattttcgatggcatcgttgaaatcgtttcgattgcacgtgaagccggtgatcgggcgaaagttgctgttcgttcaaacaatcctaacgttgatccagtcggtacctgcgtcggtcccaagggacaacgggttcaaacgatcgtcaatgaattacacggcgaaaatatggatatcgtggaatggacggatgatcaagccgtatttatcgcgaatgcattgaacccagcggaagttttggatgttatttttgatcctgaaaatgagcggggttgtaccgtggtcgttccagattatcaattatcattggcaatcggtaagcgtggtcaaaatgctcgtttagctgctaaattgaccgggttcaagatcgatattaaatcggaaaccgaagcttctgatataatggatgcaaaccctgatgatgttgcagctgctgaaacggaaacgactgaagtagcatcagacgcggcagtgcagtccgatgccggcgaagatgaggaaccagcaacgtccgacgcagccgtggcgacgcctgcctcagaaaccgctgtggatgaatcagcaagtgacgctgaataagttcgtcactaagtaagtgaagtaactaaaggaggtctgggattatgaaaaaaagaaaagtgccgttacgaaaggacattgtgacgggtgaaatgcatcccaaaaaagacttagtccgggtcgttaagaataagcaggatgaagtgtccgttgatccgactggtaaaaagccgggacgcggcgcctacattgccttagacgtacaagttgcacaacgtgccaagcaagaaaagacttttgataaggtgtttggtatcaaagtgggtgcagacttttacgatgagttagtggcttatgttgatcatcaacaagcccgaaaggaactcttcggaaatgacgcctaagcaagcttgtttaaacctactgggcctttcacggcgtgccagcaagcaaattgcaggcgaagggctagccctggctgcaattcgtaatcagacggctaaactggtctttattgccagcgatgccggtcccacgactgccaaaaagtttcatgataaggcccaatcttatgatgtttcagtgatcgatacctttactaaagcagaattaaatacggctactggtaataagcgcactgtttatgcaattaccgatgccggatttgccaagaaaatggtggcgatcatgacacagtaaaggagggtgaagatatggggaaaaagcgaatttatgagttagcgaaggagctcaacgtcccaagtaaacagctgattgcgcaagcacagcagttgggattctccgtcaaaaatcatatgtcgacactcggtgacagtgaggcgcgccagttacaaggcacgaccacagttacccatcctaaatctcaaccggctccagctaaaacgagtcgggctacgcaagccgtagcaaaaaatgtgacacgaactgctaatcagcagcaatccaactcgcgtcatcaacagagtggtgattctttgaataataatcgtaataataaccaaaataatagtcaaagtcgtaatagtaacggtaatcgaagcaataatggcggtaaccgtactaacagtaataacggcaatcgttcggccaatgcttcacggagcaacagtgctcgtaataacggtgggagcaatacgaaccggtctaacaacaataataataataaccggtctaataataacaatcgctcaaatacgagtaacaaccgtaccaacaataccggtaatcgcaccaataatggtggtcagaaccggaacaacaaccggactacgacgaacaacaataataacaacagtaaccggagcaatgggtcgaataatagttcgcgtaatggtagcggccgctttggtggtagtttgaatagcaacaataacggtggtggtcgttatcgtggcggtaacaacaataaccgtcggcgtaacaaccggaacaataagagccggaacaataagaatcaacggatccgccaggtcaataataagccagcgccagttcgtaaggacaagccgttgccagaaacactggtttacacggtcggcatgaatgcccaggatttgggtaaattattgcaccgtgagcctgctgaaattatcaagaagttattcatgttaggtgttgcagttaaccaaaatcagtccttggataaagatacgattgaaatcttagccactgattacgggatcaatgcgcaagaaaaggtccaagttgatgtgaccgatttggacaagttctttgatgatgaagttaataataccgacaatttggcgccacgggcaccggttgttacggtcatgggacacgttgaccatgggaagacgaccctattggaccaattgcggcatactcacgttacagagggcgaagccggtgggatcactcaggctattggggcttaccaagttaagcatgatggtaaggttattacattcctggatacgccaggacacgcggcctttactgaaatgcgggcgcgtggtgctgacatcactgacatcacagtgttagtagttgctgctgatgatggggtcatgccacaaacaatcgaagccatcaaccatgctaaggctgctaaagtaccaatcatcgttgccgttaacaagattgataagccgggtgccaaccctaaccacgtgatggaacaattgactgaatatggtctgattcctgaagattggggtggcgatacaatctttgttcagatttcagcgaagttcggtaagaacctagatgaattgttggatatgattttacttcagtcagaagtgcttgaattaacggccaaccctaagcaaaatgctgcgggatctgtattggaagctagtcttgaccgtggaaaaggttctaccgcaacgttacttgttcaacaagggaccatgcatgttggtgatccaattgttgtggggaatacttacggaaaagtccggacgatgaccaatgaccatggtaagcggatcaaggaagccgtgccatcgacgccaattgaaatcactggtttgaatgatgtgccggatgctggtgatcgcttcgtggtctttgatgatgaaaagacggcccgtgatgctggtgaacaacgtgctaagcaggcattgatggaagaacggaagcaaactgctcacgtcaccttggataacttgtttgattcaatgaaacaaggtgaacttaaggaagttgacgtgattattaaggctgatgttcaaggttctgttgaagctttagctggtagtttacgtaaaatcgacgttgaaggtgtgcgggtcaatatcatccatacagcggttggggcgatcaacgaaagtgacgtggccttggcggaagcaagtaacgcgattattatcgggttcaatgtgcggccaacaccacaagccaaagcccaagccgatactgacgatgttgatattcgcttgcatcaagttatctacaacgcgatcgatgaaatcgagagcgcgatgaagggaatgctcgaaccaacttataaagaagaaatcactggtcaagccgaaatccgtgaaatctataaggtttctaagatcggtacgattggtggtgggatggtcactgatggtgtcatccaccgggattctggtgtgcgggtcattcgtgatggtgtcgttatttatgatggcaagttagctagcttacggcgtttcaaggacgacgttaaggaagttaaacaaggctttgaacttgggcttcgaatcgaagattacaacgatattaaagtcaacgatgttattgaagcttacgtgatgaaggaagttccagttgaataacctttaaaagggggattagcagatggcacaacattatcgagttggtcgtttggaacaggaaatcgaacgcgaagttaatgatattttgttaaaacgggttcgtgatccacgggttgcgggtgtaaccattaccggtgtaacggtaactggcgaccttcaacaagcgaccatctactacagtattttgtcagataaggcatccgatggtgaaaagacggcggctggattgactaaggcgacgggattaattcgtagtgaattaggctcacgacttagcatctataaaaccccggaattaacttttgaacgcgacaactcggttcaatacggtagccggattgatgaattaattaataacttaaagcgtcaagattaggcgctggaaaaatagtcgttgtgaatccagatggattgacagcgactatttttgtgttcaaattgaatggagccgttcgctgtcaatcactgaggttcagcggtttagatggtgctgattgtagggtcacactagtcattcacacactgcttgaacgttgtcggtagactgactaatcaaggtagcctgctcgtgaccgtcgcaaacaattggtttaatgagtagtcgtactgaagacgatttttgcaaatagtagtaggatgaggcgaattacgcatcgtggcgcttttacaagcgaaaatgatttcttgattacaaaattaaaatgaaattagggttgacgaatcaaaatgagaatgttttaatataaacaatcaatgaaacggaaaggatagatgattatgacgacgttagcattcaacgcaacttattattatggctttgcttattttaggtagcgcccgtgttggaaccttagatacggacggcacctacgttcgtgtctaagcggagtcaattcatcttggccagctagacaccgtgagtctagctggaataatatcatcaattaggattaaattttgatgagccggctagattttcacaatctagccggctttttttatttccacgaaggagttgttattcatgcgtcagcaccaattatcaatcagtctttacttaaactactttattcatggtattggcttaattattttaacgcaaaacatgcaagcgttaagtcaacactggcagaccccgttagcgacggtttcctatgtcatttctggtattggcattggtcgcttactagcctactttattctgggaaatttatcagatcgttttggccgtaaagtcttcgtcaatcttggtatggcttgctacttcacgttctttgtggggatggcattggtcactaatattcagctggcatacggtttggcgattttggccggtattgcgaactccgcgttggatgcgggaacctacacgacgtttattgaaatgggtgggcggcaaggctcagccaatgtcttgttaaaggccttcatgtctgccggtgaattcttattaccactgctcgttgccaactttgaagcacaacgaatctggtatggctggtcatttatcctggccgcggcaatcctagtggtcaacagtattctgttgaaccggcagcagtttccactaaaaaatcaagctgctcaagccggaacgggcgtatcccagcaaccacttaagaaccggcgctggttggcgacagttggtttagctggttatgggtatacttcgatggcacttatgatcctctacacgcagtgggtcagcttgtttgccactacgacgttgcatttttcgtcagtgttagcgcactggttgctttcactttacagcattgggtcaatcaccggcgttattgtgattttctggttgttacgtcgtggggtggcagaaaccaaattgttgttggcaatgaatggcggctcgctgttggcgttagcggttatctgttatagtccagcggctgggctgtccatgctggcggctttcgggtttgggtttactgctgcgggtggcgtgatgcaggtcggcctcaatttatttatcaaaggctatccccacatcaagggccgaatcacaggaatttatttcacgtttggcagtattgcttccttcacgattccgctcgtgactgggtggttgtcaaagcaaaatattgcgaccgcgatgcgctttgatttagttattgctgtcagtggtcttgcctttgtcggcctagctgtatgggcgctacatgtcccaaccacacttagtcaagaacgccaacgtatcaatcatattgaccagcaaatcgtccgattactcaatcaacgttttgagacggttacagccatcggggagttgaagcaacaacagcaacttccggtattagaccagcaacgtgaacaacgggtgttacaacaagttgcggtgaagagtacccagaccgcgcataccccttatttacaagctatttatcaagcaattatgcataactcacgcgcatatcagacggatttacacacgaatttacacaaggaggatattgatcatgattaattacgttacggcaggcgaatcgcacgggcctcaattgacaggggtgctgaccggtattccggctggcttacagctagacattgatgccattaatacaggcctcgcagcccggcaaggtgggtttggccgcggcaatcgccagcagatcgaacatgacaccgtccaaatcactggtggcgtgcggcacggtgttacgctaggttccccgattgcattaacgattatgaatcgcgatcacgcgcactgggcagcaatcatggatccggtaagtccagctacggcaaccaatacgttgcggcaagtcactcgtccacgtccggggcatgctgacttagtaggcggaatgaagtatggtcatcgcgatctacgaaacgtgctagaacgttcctcagctcgtgagacagccatgcgagtggctatcggtcagatttgtaagcaattattggcgcagctagatattcacctagttggctacgttcaacaaattggccctaagcaagtgacggccgatttaacactatccgttgatcaattacaagcccaaatcgcgcaaaatgatttgcgattaccagatgcggccttggttcccgaaatccatgagctgatcacagcaacgaagaaggccggggataccttgggtggtgttatccgggtcgttgccgaaaatgtgccggctggtttgggcagttacacgaactgggataccaaattagatggacagttagccgcagcagtgatgggagtcaatgccatgaaaggtgttgaaattggtgatggatttgcggctgccagccattatggtagccaagtaatggatgagattagttgggatgaacacgccggctggtcacggctgaccaatcatttgggcggctttgaaggtggcatgactaacggaatgccgattgttgttaaggccgccatgaagccgattccaacactttacaaaccattacaaagtgtggatatcgcgaccaaagtcagccaaaaggcaagcgtagagcgttcagatacgacggccatcgtccctgcctcgattgtggttgaaagtgtggtagcgattgaattaacgcgagcattgacggcaacgtttgacgggagtaacttagctcgcctccagcaaacagtgacggcataccgcgaagaactccgacaatattaggagggcctatgcagattcatactttaggcccgaccgccacggatagttacgcggccgcgcaagtttataatcatcgcaactggcaggaccaagcggtgattgtcgaacacccgagctttgaaaccattttaactgatttaacggcctattctggtgaccaactggtgataccagctgctttcaaatcagacacactgaatgccagctggggggatatacattacgcattattgtcccaattaacgttgagcagttgttttatgacccagctcgatccacttgtcgtgctccaacgagtaaatgccgataatcaaattggttacacgcatgcagcgaccgcccaattgttgacgagggtcgtgcatcaggtcgtggtgcaaacagtcgccagtaagtatttagcgtatcaggcttatcaacgtaatcaggcggcctacgtgctaactaatgagaaaaacgtgacactgacgactcatgaacgtgaacttgcacgtttgacaccttcgatggtgtggtgcgtctatcaaataaattaggtgatgatgattaatgataaaaaaactaagtattcaaccagctagtgggttacaaggtgacttaagtgtaccaggcgataaaagtgtctcacatcgaggcttgattttaggggcaattagtcaagggacgacgaccttgcaccactttttgccagccgccgattgcttatcgactttaacggcgctgcaaaagttaggggtgccaatcaagcgtgtcgatacgaccgttacgatcagtggcagcggcttacgtgggttgacccaaccacaacaaccattagacatggggaatgcggggacggccactcgcttattaactgggttgttagccggtcaaccgtttgagacgaccttggtcggcgatacgtcccttagtcaacggccgatggagcgagtgcgtcaaccattacaagccatgggggcgcaggtacaattaacagccgggcacttaccgatgacgatcactggtcggactttacatggtagtcgtaccgagatgcaggtcgctagtgcacaagttaagagcgccttgattttagcagccctgcaagccgatcaagcaagtacgattattgaaaaattaccgactcgtgaccacactgaacggttgttgcaacaatttggtggtcaaattgaaacggcgcctgatcaacgaacaatcacggtccaaccgcagccagccttggttggtcagtcactaacgattcctggcgatttttcctcggctgcgtttttcgtgacagccgcgacgattattccaaattcacatgtccggttaacgaacgtgggactgaatccgacacgaacgggtttcttaaacattttacgacggatgggtggtcaagtgacggtcgatcatgaacaccggatgggcgaaccagttggcacgcttgacgtgcggtttgcacaactgcatccggtccaagtcactgctactgaaattcctgccgtaatcgatgaactgccactagttgcattgttggctgcgactgcgaatggtattagcacaatcagtggggctgctgaattacgagtcaaggaaaccgatcgcattgcaacgattgtgaccgagcttcgaaaacttggtgtgcagatcacttcgcaaccggatggcttcgtgattgatggtcgcaagtcttggcggcagccgaccgagccattagccagccatggcgatcaccgaatcggtatgatgatggcaattgcagcgttgcgattagccgctcccgccgaactagagtccgccgaagctgtgaacatttcatacccgacgttctttgaagatttagcacgtttaagccagggggtgtgaagatgacaactgtattgatcaaaggtttggggctaattggcagttcgttggcactaagcattaagcaggcccatcccacggtgcacattattgggattgatcgtgacgatgtcagcctgagttatgcgcgtcaacagggtatgatcgatgctagtggcactgatttggccgcggtcgcgagcgacgctgatgtgattattttagcggggccagttgatttgatcgttgctgatttgcaccgactggctatgatgccactcaaggcaggggtgcttgtgacggatgtcgggagtactaaacaagtggtgatgcatgccgcgcttgccatacaacagcacggtgtgactttcatcggcggtcatccaatggcgggttcacataaatcgggtgtgacggctggccgcgccaacttattcgagaacgccttttacttgttagtgccgggccggactaatcaagcagccgttcaacggctgcaagcattgttacaagcgactcacgtcaaatggttgacggtcactgcaatacagcatgaccggattgtaggacagttaagtcatttgccacatattgtcgctgcggcattagttgatcagactcaggtggctttggcagattcggcactcgggttgcgattagcggctggtgggtttaaaagtattactcggattgccagttcggaccccacgatgtgggcggccatcctgatgactaatgctgaactaataaccaatcaattgcagggttatattgaccaactgttgcgcatcaagacagccattagggtgcatgatcaagcaacattgtacgaattttttgcgacagctaaggtgacgcgtgatcacttgggaccggaacagttgggaggactaccaaacttttatgatttgtttttgaacgtccccgaccgtgttggcgctctcgcggatgtcactcagcggctcgcacaggctcagctgagcttagtcaatattcatattttagagattcgtgaagagattgatagtgtcttgcaactgacatttagtgatctaaagacgagaacgcaagcatcgtcgttgttagctgatgcgggttatcagattgtaaggaggaattaagaatgcgagcaattttaattggatttatgggtagtgggaaaacaacggtcggtcggcttttggcggccgggttagcaactaaacatgctgatttagatgatttgattgttcagcgggcgggacggtcgattacgactgtttttgcggagcaaggagaggggtacttccggcaattggagcatcagactttgctccaagcactcgaaacacccgggattttatcgaccggtggtggtactccgaccattgcaatgaatgcaattagtctgaaacaaagcacggtgccagttatctggttgacggctagtgatcaaaccactattaaccgtgttaaaaatgatactagccgaccacttgtcaatgaattggatacaggggcactgattgcgttgaagcaacggcgccaagccttatatgccgctgcggccgatttgacgatcgcaaccgatcaactgacaccccagcagattgcccgccaaattcagcagtggctgaatcagcaaccagttgcgctccaggcttgaagaaccatgtaactgtggttagcgtgccggttgcattttaagacgataacattgaataagcgtacatcagccacactaaggccgttgcacgcttttttgatggcagcatatgttgaaagtcatcggcgtaattagggacggtcccgcgcggtatccttttgataaggggactaatttgtgcgattcttgtttttcagtcgttttatttgactaatagggattaagctcacggttttctggatcaatgagttaaatacagctttgccaggcacatacgtggtcgtcagtggcaccggaccagcgtgtcgatttggggtatcttagttgcggtgctcagggccttgaattctgtgataatccgcttacatatttgtgaggtgtggtatactgaaaaccgtcgattaagaacgatcgaatccgtggcacggcgattggctgccactagaaaccgaatttaaatgattgaaggcgttttttatgttgaacgggattctaccattatataaacctcgtgggatgacgagctttgactgtgtcgctaaaatccgacgactctatcagacccgcaaagtaggtcattcagggacactggacccaaatgtggatggcgttttaccgatttgtattgggaatgcgactaaagttgtgcaatttttagtggcttctggcaaagaataccaagggagcattaccctcggatttgcaacgactactgaagatttagatggtgaggagattgcgcgccaagcggtcacagagccgttcacaagtgaccaagttgatgctgcgctggcacagatgacgggggccattacgcaaattccaccgatgttttcagcagtaaaagtaaatgggcggcgtttatatgactatgcgcgcagtggtgaaactgtcgagcgcccagaacggcatatcacaattagcagcttcaagcaacggcaggcatctacctatgactcggcaacccagactcagacgatctattttacggtcgcttgtagtaaagggacttatgttcgcacgctagcggtggatgtcggcaaagtgctcggggtacccgctgtgatgagtgatttgacccgattaaagagtggcggctttactttagatgaaaccgtgacctttgaggaaatcgcggcccacgtcgatgctggaacggccggagcattattggcgccaattgataaagctttaagtcagtacccgcgagtcacgttaacggatgagcagtggcaacgggtcaaaaatggggcctttattacggcggcagaagggcaacaaactgatccagatgcgaacacgatggttgcgttagtttaccaaaacagcctaaaatgtctatatagttatcgaccggacgaacagcggtacaagccgttcaaaatgtttgcggtcaattaaggagtttttgtcatgcaggtgattaatttaaagtatcccgtggcgttgagtcagattcccgaaggaccaatcgtattggccttaggattttttgacggcgttcaccgtggacatcagcaagtcgttgcaacggcacgccaggccgctcaggcgcaacacgccaaactagcggtgatgacgtttgaccagcatccgtcagttgtttttaaacacactgatccgcagcaagtccgttatttaacgacaattgatcaaaaaacggcattgatgagtgagctcggcgttgacatcttatatgtacttcactttgatgccacggtcggtgccatgccaccccaaacgtttgtcgatcagttaattgttggattacacgcacaaacggtggttgctggttttgattacacgtacgggccagctgaaattgcaaatatgcagcgtttgaatgactatggtcataaccggtttgaaatcattgaagttcctaaggcggaattagatgctgaaaagatcagttccacgcggattcgccgcgctttggacgcgggagatatcgatacggctaaccggttactgggctatcaatatgaaactgccggcgaagtagttcatggtgaagcgcggggccgaacgctcggctttccaacggccaacgttgctcacgggcccaatacccgggttcccggaattggcatttacgcgacgatggtgcagattgggacacgctgggttatgggaatggcctcagttggacgaaatgtcacgtttggtgatcaccgaccaatcacggttgaaatatacttattaggtttccaaggagatctttatggccacaatttaacggtgcgttgggggcaccggatgcgcggtgaaattaaatttgctggggcggatgccttggttgcgcaattaaagcgggatgaacaaaacacccgtgactattatgtggcgcatccctttgtggtcacaccccggattcaagttgcacaacaatcaaatcgtttggaggcacaatgaatggacacaacaacaatttttcaacacggcacattaggcttacttgttcccggattatttgacgggacgattacggctggtgaactcttaacccatggtgatacgggtattgggacgttagacggtctcaatggtgaagtgattattctaggaggtcacgcctatcaagcacgtgaggatggtcaaattcgggaaattcagcccgaagagacgttaccatttgcatcggtgcactttgaaaagcctgatattagtgcgcaattagctgcaatcacacaaactgatttcgagcaacaagtggttcatgactatcgtttgaccaacgtgtttgcggctattcgcgtcgatgggacctttgcaaaagtcaagacgcgagtcgcgcctcgtcaggagccaccgtacaaaacattagtcgcggcaacggcaacacaaccggaattcaccggtgaacatgttgacggaacgattattggctactacgcaccgcatttgttccaaggcgctacggtcggtggctttcacttacactttctaagtaaagaccatcaattaggtggacacttgctggggtttgaagtcgaacaagcgacgctgaaagttcaacattttgctgactttcatgtgcacttgccaatcgacaatgaagcgtacttacaagaacaatttgataatgaaaccattgatcatgccattaataaagctgaacgttgattagtttgaaagctgattaccgttaaggccaggtttcactagaatgtctgttggcaatgtacatcaggctagtcaaaaatctcgagagtctgtaactcttgagatttttttgttgtggctggtgtgctgagtaatggcagcagaaaagcgagtagtctgctaggcaccatgcttgcattgtgaagggtgagggtgtatattagcactcgtaagtaaggagtgctaattgggggcgacggtcaattaagtccagtcatagtgggactggtgtcctaataatttaagcattcttttctagaaatactttgtctttccttgactttcatcagggtggttgttatattagtaattgtgttagcactccattaagttaagtgctaaaaagaggtgatgatcacgttaactgaacgacaaagcctaattttaaaggccattgtccgtgactataccgagggcggtaatccagttggatccaaatcgctagttcaagaactaccgatcaaggtcagttcagcgacgattcgtaatgaaatggcccgactagaagatttaggattaatcgtcaaaacgcatttgtcttcagggcgaattccatcgattaaggggtatcggtactatgttgaccatatcctaaagcctgaaaaggtggatggcaaagacttgaaggtgattcaacattcattaggcggtgaatttcacaagatcgatgagatcgttgctcagtcggcggatatcttgtcgcaactgacaagttacacgacctttacattgcgacctgaacttaaagatagtcggttgagtggtttcagactcgttccgttggggaatcatcaagtaatggcgattctagtgacgaataatggtgacgttgaaaaccagacgtttactattcctagtgacattaccggcgatgagctggaaccggtcgttcgtttcattgacgatcaactggttggcctgccgttacaagacgtcctccgccaattaacgcatgagattccgttaaaacttgcacagtatttgcaagatccagatggtttcttagatatttttggcagtgtgttgtccaaggcagcttccgagcgcttttatgttggtggtaagttgaatttgttcaactatacggaccagcagagccctaaagagttacagtcattgtactcgttactcgaccaaacggaccggttagctaacgtgattggtccacccggtcaacggattcaagtccgaatcggtaatgagatcaccaacgatttgttgaagaactacagtttaattaccgcgacttacgatgttgatcaacacggacaaggtgtgattgctttgctcgggccgaccgccatgccgtattcacggatgattggactgatgggtgcgttccaacgagaattagcccgcaaattattagattattaccggtactttgacgagtgacggacagggagatgaaaacattggcaaagaaatcaacgcggacgacgccggaagattcacaagcgtcaacaactgattcagcagcaacgtcaactgccagtgaagcgacacaggcagcgacgagtacgactgatgatcaagctgagcaaacgacagcggtcgatccgacacaacaaattactgatctcaaagcgcaattagatgcgaaagatgaccagttattgcgtgcacaggcggagatcgtcaacatgcaaaaccgcaacaaaaaagaacaagcggcgctgttgaaatatgacggtcaagcacttgcaaaggatgtcttaccagttctggataacttggaacgggctttggcaacgccagctgacgatgaagcggcccaacagttgaagaagggtgtcgaaatggtctatggccatttacaggatgctttgaaaaaacatggggtcaccgaagttgcggctgcgggcgaaaagtttgatcccaatattcaccaagctgttcaaacggtgccagttgatgatgatcatccagctgatacggtggtacaagtcttacaacggggttacctattgaaagaccggaccctccgtccagcaatggttgttgtggcacagtaattaatcaataaaaatactaaattaaaaagaggtttgttaatttatggcaagtaataaaattatcgggattgacctcgggactactaactctgcggtagcggttcttgaaggtaatgaacctaagattatcaccactcctgaaggtggccggacggttccttcagttgtggcattcaaagatggcgaaactcaagttggtgaagttgccaagcggcaagcaattactaacccgaatacggtagcttcaatcaagcgtcacatgggtgaagctggttacaaagttagcatcgaaggtaaggactacaccccacaacaaatctcagcaatgattttgcaatatatcaagggctttgctgaagattacttgggtgacacggttgaaaaggccgttgtgactgttccagcttactttaatgatgcccaacggcaagcaactaaagatgctggtaagattgccggcttaaacattgaacggattattaacgaaccaacggcggcagctttagcctatggtttggataagaccgacaaagatgaaaagattttagtctatgaccttggtggtgggacttttgatgtttccatcttggaattaggcgacggggtcttcgaagtattatccacaaatggtgatacccaccttggtggtgatgactttgaccaaaagattatcgactggttagttgatggctttaaagctgacaacggtgttgatttatcaaaagacaagatggccttacaacggttaaaggatgctgctgaaaaggctaagaaggacctttcaggtgtttctgaagctcaaattagtttgccatttatttccgctggtgctagtggcccattgcacttggaaaccacgttaacacgtgctaagttcaatgaattaactgctgacctagttgaaaagacgcgcattcctgttgaaaatgccttgaaggatgctgatttatcggctagtgacttagacgttgtcatcttgaatggtgggtcaactcggattccagctgttcaagaagctgttgaaaagtggactggcaaagaatctaaccattctatcaaccctgacgaagcggttgctttaggggccgctgttcaaggtggtgtgatcactggtgatgttaaagacgttgttttgctcgatgttacgccactttcacttggtattgaaaccatgggtggggtcttcactaagttgattgaccgtaacacgacgattccaaccagcaagtcgcaagtatttagtacggcggctgataaccaaccagctgttgacattcacgtgctccaaggtgaacggccaatggcagcggataacaagacgttaggtcgcttccaattaacggatattccggctgcacctcgtggtgttcctcaaatcgaagttaagtttgacatcgataagaacgggatcgttaacgtatctgctaaggatatgggaactaataaagaacaaaagattaccatcaagagttcatcgggtctttctgacgacgaaattgatcaaatggtcaaggaagccaaggaaaacgaagaagccgataagaaacgtaaagaagaagttgatttgaagaacgaagttgaccaattgatctttactaccgacaagactttgaaagatcttgaaggcaaggtttcagaagatgaagttaagaaagccaaagatgctcgtgatgctttgaagaaagctcaagatgataacaacattgacgaaatgaaggccaagaaggacgacttgaacaagatcgttcaggacttatcagttaagttgtatcaacaagctcaagaagctcagggtgcacaaggcggtgccgacagtaatgctgctggcaatgccgactcagccaagggcagtgatgacaacacggttgacggtgatttcgaagacttggataaagacaaggataagaagtagcaccggcagaacaaaaaggccaaggccacgtggctttggcctttttgctttaaatatgctagtattaatgagacttaattaaggttcattaggaggttacaatggcagagcaagacttatataaggttctgggtgttgaaaaggatgccagtcaggacgaaatcaagaaggcgtaccgcaagctttcgaagaagtatcatcctgatttgaatcatgaacctggcgcggaagaaaagtttaaagctgtcaatgaagcgtacgaaacgttaggcgatgcccagaagcgggcacagtatgatcaattcggatcgactggtggccaacaaggcttcggtggcgccggcggtttcggcggtcaagactttggtggcttcggcggcggtggcggctttgaagatattttcagttccttcttcggtggtggcgctggtggttcacggcgttctaacccaacggccccgcaacaaggccgagacttacagtatgagatgacactgaagtttgaagatgcgatctttggtaagaagacgaccatcacctacaatcgtgaggaacagtgtgagacttgtggtggttctggtgccaagccaggaacgtcaccagtgacctgttcgaaatgtcatggtgctggctatattcaggtacagactaatacgccactcggtcgaatgatgagccaacaagtttgtgacgtttgtcatggaactggtaaagaaatcaaggacaagtgtgccacttgtggtggctctggtcatactgaacaaagtcattccatcaaagtgacggttcctgctggagttgaagaaggccaacaaatgcggcttcaaaatcaaggtgaagcgggaacgaatggtggcccttatggtgatttattcattatcttcagagttgagccaagtaaggactttgaacgggatggcgcgacgatttacttcaagttgccgatcgacttcgttcaggccgctcttggtgatgaagttcaagttaagacggttcacggggacgttaagttgaagatcccagctggtactcagacggggacaactttccggttacgtggtaaaggtgcaccacgattacgtggcaatggcaacggcgacgaacgcgttaccgttaatattgaaacgccaacgcacttgaacaagggtcaaaaagaagctttgaagacctttgctaaagctagcggcaaatcagttgctggcaatggcaagagttcgttatttgacaagctccggggtgtttaaccgagcgaactaattccagaaatatacaaaaagctgggcgatgcccatcacaaaaatgtgatgaggattgttcagctttttttagtgtcaatcaagcactctggcctgtttattaagtgacctttcagtaacgcggtttttgtgcaaactgtttcgttatcctgtcgtccggggattagtgagtgctagaattagtcaaggaggtgaagtaatacgctgctagcttacgggggacgtaacgttgatgttacaaaaccgttacaaatatgtcgtatcagcgaacgaaaatgcaggattttgatctttttgagccggcctaaccgttattggtcggtaggttgttacactataacttgaacttacgtcctattggcggcgtagctaatatcaccaatcggttcgtaattgatagctaatggggaggtcaatcattgtgaagcaaagcaaacttttagtaacagttttgcttggactgctgattgtgggtgctggtggcggctactatgtttatcatacagagcggcaagcagcgattgctaaaaagcgtcaaactgacaaagcattgaataagaaagcggcattaaaaaatagccagcttagtcgtaagattaaccagacaacgttttcgaataataagaacacggatgagcaagtgactaaggctttaaacctaagccattttgtggggtcagcattagttgttaagaatgaccatgtcatttataatcgtgcctttggttacgcaaacaaggctaaaaatcaacgtaataaagtcaattcaaagtatcaaattttatcgattcaaaagtcaatgacggcggttggcattatgcagttggtgcaggcggggaaagttaagctgactgatccgatttcgaagtattatccaactttaaagcatgggcgtcagacaacgcttcgccaaatgttagatatgacaacagggttccgtttgaagagcggttcaaaagaattcttaccagaaaatcaagtgattgattttgcggctcacaatgttttttactacccagataaaaatggaatttataattattcatccgttaattttctgttgctagctggcattattcgcaaggtaactggtcaatcatatcagcacttctttacaacacattttattgacaagttgaatctgaatgaaacgggctttttgattcatggtcaaggtcaagatgcgacaactggttaccgagcgcttgcagaccaaacacttccgaattatgatcaaacaatgccagaaagcaaatcacaaatggccaatgagttaggtactgggcaagtttatatgagtaccgcggatttatttaccgttgaaagtgccattcttaaagggcagttgctgtcaaaaaagaacgttgcaattttgcacacgcgcacagccacaggtgaatatggcggtggtgtttataacatgagtaatggtattcggtcacacggacttggttatggctatgaatccagcatcttcctctcaccggatgggaagactggtgttgtattaatgagtaactactatcgcaaagctgctggtattcaagcaacagccaacaagatttttacggaattaatgaagggtgatattaagtaactgacattgggttagtggaggaggtgatggcatgtttgcaaagttgaaaagctggtttcaacgtccggtcgttcaattcattgcacttacagtattttactttgctgtcatgctcgccttggtttatctttacggttatagtgggatcaaccaagcgaagtttatttacaacgaattttaaaaatggatgcagtaacactattgtttggggggagttttaattatgattaagaacatcattacaacgattgatgattatgcacggacgcaacccaataacgtggtttatgatgtgcaaggtgtaacgcacacttatgcggaattaaaagcttattcagatgccttggcggcgcatcttgacacgctcgatttaccagccaaggatccaattattgtgtttggtggtcagacgtttgaaatgattgcgactttcttaggagttgttaagtcaggtcgggcgtatattccaatcgatacacattcaccaaatgagcggttaacaatgattaatgagattgctaagccagctgccgttattgctgttgctgatttgccaaccggtgtcgggacaacccccgtgattacaccagatcaattggcggctatctttgcgactcccgttgattatcaagcggatcatgtcgttagtggcgatgataattactatattatctttacttctggtaccactgggatgccaaagggggtccaaattagtcatgataacttggtcagttacgttgactggatgttgagtgatgacttcggattgcctgaccagccgaactcgctgtcgcaaccaccatattcatttgacctatccgtgatggacgtttacccaaccttagcgttaggtgggacactatacgcattaccgaaggccgtgacagatgatttcaaacaattatttgctgcgttgccgacgttaccaatcaacgtttgggtctcaacaccatcatttatggacatttgtttgctagaaccaaagtttaatgctgaaaacttgccaactttgacgcacttcttgttctgtggtgaggaactcacacataagacggcggcgacactcaagaaacggttcccagatgcccggatcttcaatacgtacgggccaactgaaacctgcgtcgcggtaactcaaattgaaattacggatgccgcattagcgcagtatgatcggctaccaattggttatgccaaagctgatacgcggatacttgtggttgatgaaaatggtgaggcggttccaaatggcacggaaggtgaactgattatcgccggaccatccgtttcgaaggggtatttgaacaactctgaaaaaactgccaaggctttctttgaattagacgggcaacccgcctatcattctggtgatattggcacgatggatgcggacggtctgttccgttatcgtggccgcgttgattttcaaattaaaatgcatggttaccgcatcgaactagaagaagtggatcacttcttagcacagcaacagcatattaaacaagccgttgccgttccaaaatacgataaagagcacaaagtaacgcaaatgattgcgtacgtggtaccaaagccgaatgacttcgaaagtgactttgctttgaccactgcaattaaaaaggacctacaaggaatgatgatggaatacatgattccacaacggttcgtctatcaaacgagcttgccattaacgcctaacggtaagattgatgtcaagtcgatcattaaagaggttaacccagaatgatttcttttgacccatatggtaacccaacgtactttgtgctgctctttatcgcgttgttaccgttaatgattggtctgttatatggtcggcgatcccattggtatgaatcattgatatcgtttatcttcttaatgctgacctttggcggtgttaagtggcgcactgggatcgcgttaattatctatttggtctatcagatcacactagtttggttgtactcaaagtatcgacaacgaccagattcacctaataagggctgggttttcgttgtcagtgtgattttagcgattattccactagctgtcgttaagatcacaccagccgtggcacatggtgctaattcaattattggtttcttaggaatttcctacctgactttcaaagtggtccagatgatcatggagacccgtgatggggtgattaaagaattccatccggtactgtttggccagttcttgctgtttttcccaacgatctcgtctgggccgattgaccggtatcggcggttcgttaaggattacgatagtgtcccgacccgtgaaaagtatctcgggttagttgaaaagggggtccgctacattttcttgggattcttatataagttcattttggcttatatctttggtacgcggatgctacctgtcgttgaacacgcggccttgcaagctcacggcatgtcatgggcgttagtcggtgtgatgtacgtctatagtatggatttattctttgattttgcgggttacagtttgtttgccgtcggtatcagttacctgatgggtgttgaaactccgatgaacttcaatcaaccgtttaagtcaaagaacatcaaagacttctggaatcgttggcacatgacgttgtccttctggttccgtgatttcatctacatgcggttggtattctttatgatgaaacacaaggtctttaagagccggatcacaacggccaacgtggcatacgttattaatatgttgatcatggggttttggcacggggaaacatggtattacatcgtttatgggctattccatggtttagcaatggttgtcaacgatgcttggttacggtacaagaagaaacatcaagcgcagttgccgtctaataaatttacggaatactttgcgattttcctaacgtttaacgtcgtttgtttcagtttcttgatcttctcaggattcttgaacacgttattctttggagcccggccataatataattacaataagggagcgtaatgacaatggatgatacaaaagcaacggttttatcaattttagcagacttaacgggggaagatgtttccagtaacatggacgttaacctgtttgatgaaggaatcttagattcaatgggttccgtccaacttttattggaacttcaaaatcaattaggaatcgaagtgccggtctctgaatttcaacggtcagaatgggatacaccggctaagattgttgcaaaggttgagaacttgcaatgaacgttgccaaacgcctttttaagatttttgggccaattattttggcagccgtcttattattggccgtactgctttcaccgttctcatttggattaaaccatatttctaaggatactgagaaaaaagcggccgtttccttgtcagccaacgtattaaaaggtcggttagttaaacgacaggcgctggatgatggctatgtcccgttctttggttcttcagaatggtcacgatttgatccaatgcatccgtccgtactggcaacaaaatatcaccgcaattaccgaccatttctactcggtgcgcgggggacccagtcgttgacgcagtatttcgcgatgcaatcggtgaaaaagcagattacaaataagaaggccgtctttgtaatttcgccacaatggtttgtgccacaaggaacgcggaaagatgcgttttcgtactattactcaccactgcagaccattgattggttacaggatgagcagaatacggcaatggaccggtatgccgctcaacgtttgttacagatgccatcgggttcttctgatcgcattttggaaggcgccctggcacgtgtggcagctgggtttaaaccaacgagcgcacaaatgacgtatattaactataaggcacgtgtccttggcagtgaggatgagttcttctcacgttttggaattgcgggcaaaaatttacggactgtcaatgcgcaagctaacaagttaccagcgacatataactttaatcagttaaaccaattagccggtaaaatcggtgcggcgcaaacggactcgaacagtcttgaaatcagcaatcaattttggaacacgaagttaaaacgtaattacaagcgactcaaagattcacagcgacacttgaattacacgaagtcaccagaatttgccgattttcaactggttttgaatcagtttgcaaagacacacaccgatgtcttgttcatcattccaccaatcaatcagcgctggtctgcttataccggactgtcaatgaagatgattgctcagtttgacaagaagattcagtaccagttgaagagtcaagggtttaataacgtcttggacctgacccaggacggtggtaaggactacttcatgactgatacgattcatcttggctggcgtggttggttagccgtggatcaaaaggttgatccattcttgactaagaagacgaagccggttcattatcagattaatgacgacttctattcaaaagaatggcaattactcaaacccagtgaaatcaaggattttgaataacctactaaaaagtacaggccatattggcttgtacttttttgttacgtcatttattcagtggcgcagcggggtgtctggagcggtctgatagaaaaattgtgcttgtgccactaacttggtataattgtagggattaggatttaggaagaaagtaggaaaatcaatggataaagcgacaatgcaagaccgacaacaacatattcggaatttttcaatcgtcgcccatattgatcacggcaaatcgacgttggcggatcgtattctggaactaactgatacgatttccaaacgtgagatgcaagaccaagtgttggactcaatggacttggaacgtgaacgtgggattacgatcaaattgaatgcggtagagttacactatcaagcaaaggatggggagacttatatcttccacttgatcgatacacctggacatgttgacttcacgtatgaagtctcacggagcctcgcagcctgtgaaggggcggttttagtcgtggatgcggcgcaaggggtcgaagcccagacgctagccaacgtgtatttagccattgatgatgacttggaaattgtcccggtgatcaacaagattgacttgccatcggctgaacctgaaaaggtgcgcaaagaaattgaagatgacattgggattgatgcggaagatgctgttctagcttcagcgaaagccggtattggtatcgaagatctgctcgagcaaatcgtgcataagattccggctcctcagggggatcttgatgcgccactcaaggccctagtgtttgattccgtctatgatgattatcggggcgtggtgctgagtgttcggattcatgaaggcatcgttcgtccaggagatcggatccggttgatgaacagtggtagtgaatatgaagtgacggaagtcggcgttaattcaccgaaaccgttagcacgggattatttgatggcgggggatgttggttacattacggctagcatcaaggatattcaggatacccgagtaggtgatacggtcacgaacgcgaaaaatccggccgaaaagccattggcgggttaccgtgaaatgaatccgatggtctacgctgggatttatccgactgataatgccaaattcaccgatttacgggaagcgttggaaaaattaaaattgaacgatgccgcattggaatttgaagcggaatcatcacaagcactgggctttgggttccggtgtggattcctgggactgctacacatggacgtcattcaggagcgcctcgaacgggaatttaatcttgaactaattaccacggcgccgtccgtaacgtatcatgtgcggatgactgatggcacggagaaaaaggtggaaaacccggctgaaatgcctgaggcgtctgcaatcaaggaaattcgtgaaccgtatgtgaaagctcagattatggtgcctaatgattacgttggtgcggtcatggaattagcccagcgtaaacggggcgagtttgatacgatggagtacttggatagtaatcgggtcaacgtggtttatcacattccgttgtccgaaatcatttttgacttctttgataaattaaagtcgaacacgcgcggctatgcctcgttagattatgatttagacggctaccgtgccagtgacctcgttaagatcgatatcttattaaacggtgaccaagttgatgctctgagttttatcgcacatcgcgactttgcacctgcgcgtggacgcgagattgccgccaagctcaagacgattatcccccggcaaaactttgaaattccggtacaggcaacgattggttctaaagtcattgctcggacgaatattaaagcttaccgtaaggacgtgacggcccatctgtacggtggtgaccggacgcggcggatgaagctacttgaaaagcaaaaagctggtaagaagcgtatgaaggctgtcggtaaagtcgaaatcccgcaagaagcgttcatggctgttctgaaaaccgacgaagacgaaaagccgaactgatagggttccgcgtaagcggagctcttttatttttccgttttgccaacattttgccaacattgaaactgtgatgttggcaaaatatacatatatcgaaaaaagtgtctatcatctttttaactgttgttttttaacatattttcgaagatatcaacagtatcacgtttcatcttattggttacgtgggaatagatatctagcgttgttgaaatacgtgagtgaccaaggcgttgctgtatttctttgtacttggctccattttctagcagcatcgttgcgtgtgtgtgccgtaatgagtgaaaattaaatggaaagtctaattcctgtgatagtttagttgtgtagtatttaattacgctaggggtaatcggcttaccattttgtttggtacaaacaaatgggctatcaaagtaaaattgtccgtaacgcactttattttccttctggtaagttctgaaacgctttaaaacagttagcagtgaatttccgactgcaattgtacgatagcttgccttagttttgggtgacgtaacgtcaaattcttttttcttcataatcatttgcttgttcacggtcaaggttttgttatcaaaatcgatgttgtcccatgtgagtcctgaaacctcaccacggcgcaagccagtgttgaagctgataataagtgggagatacaaggggttagattcaggaacaagtgctagtatctgcttgaactggcccatattgatgattttgagcttatctcgagcagcttgctgggttatttcatcatcattattattagtgggctttacaatgtagtttgctggattttctttgattaattggtaagggaagacggccatcttaaagcccttacgtaagactgaaacaatgatctcaatagtgtgctttgagagcttgtctgtgggtaggtcatttacgaacttttgaattgatgctggaccaattgatttcattcggtacatgccgatatcgggcttaatgtaattgttgataatattacgataattcgtttgcgtgttatatttaagagtctttacaacaaaattctcgtgccaataatcgaagtagtctgctacactcatctctgtcaacttgatgacaacaccgccgcgctcaaactcatcaattgctttgcgcagggcccgttctgcttcttcacgggtccgaccaccaacgtgctcgattcgctgccgtttaccgtctatggtggggccttcatatgcataataccagcggttgccacgtcttctaattgatcctcgcatttttatacttcctttcagtctttaatgtcaaaatgaacaacttcactaccagcagaataaagcatgtagttcttgcgataggggaataggcccaaccgtgcaatagcgtcaacggtgatatagttgggtcggacaagtccatagcgatgatccccaatagaaacgtgatagcctgtaaatggtacgtaggtgatgtacacggaccatttatcatcgacgatgtagccggtagtttttgagcgtcctggtccgggataaaacttgtcctgcagctccaattgtttttgttcttttccggtaattttttgaataatcatgataatatcctcctaatgtccaaacgtatgttcttttttacttttaaataaaagcccgtgttgggggccaattttctaatttacagatactgaatcaacaacaatatcagattttaaggtcttaccatttaattttatggtagatgtgagtgcgccaccttttacagtaatattatcgccttcattaatgttagtttcatcaaaggtatccacattgatctctgtaacagtcccgtatgagtagcctgaagatgcatggtcatctttagggaggataacaacataatagatatctgtattatctggattcttttgaatgtaggcaacttctccactagtttcgacgtttttaccgatgtatttatcagtttcagttgcaaatgtttctaagtcaactttatcataatggatactacgagtagtagatttagcagcagacgacgaactatcactagaattatttttggataccgattcgtcaaatgaagaattggcagcaaccatagaatccatagccgaactagatgaagatttataagaattaacggcctcagaagaaggtttaacaattatttttttataaaccttaagcttgttaacgttatttttattaggttcgttggaaataggatcagtatctgcgtcaatatcatcgattgtaaggtaatatgggacagtctttgcatcatcgttgtcttcattaaaatgaaataggcctttagaatcacttgtaaccgtatccttaacttgaccactcttattgagaagataaacaccgatattttcttccgttcttccttgaactgagaacttgctattgtcagaagtgacaatgctcgaatgattaaccgtaatagttttttcctttttgacattggtcgcagtttctttgtgatgtgagcttgattgagtagatgtttttgaactattaccacaaccgcttaatataaataatgacgcaacaatggcagccccagtgactacttttttcatataagactcctccaaataaggtgcttttcaagttgacttttaatgacttctagcttgttatgagtgttggctccaaagacattgaagtcaggctgtgccaacaataaaaaagagcatgcttattagattatatcaatgcaagtatcattgatagattagaattcaataaaaatactaattgctattaattacgttgcttgtataccgtacgatatgtatataaaaaaactaccatcagaaacctgagtctttgatggtagttctaactgacgaacactaattatcagttcttctaaacgaagcaccaattaaccccaaacatcatccatatgcggtagttgtaataagccatcgctagtcgggtcagttgtgccgatggtctttaaatgccaagtgccctgatcgtccttggtcgcaacgacttttttgcgtttgccttcttgatttttgtagaagcagttttcactatccgcaccgatttcgcgggcgaggacttcgttggatgtgacataaccgtcattggtttgaaatttttcgatttggtcgaccgttgtcaactgttcatgaccacgacgataaattctttcgatgagtatcatcagtaaattccccctaatattgataaccttactaatttaatcatattttaccatactcggatacgcggcaaaaacaattctgaaatggttagcaaatttataagaattaaagttcgatacttgctaaaccaatggcaaattggtacactacttgtttaaagtctgctataataatagctagatatgaaaatatactaacgataaattaatttattatttaatcaatttcacattgtgaaggagagatcaacgacatgttaaaacgcacgaaacagtttctgcgatcaatacattatgactacgataaaacatatattagaccgctgatggtgcccgacagcgtttacgtgttgaaattcggtaaggaccatcgcaacaatcgggtggtcgttaagtacagtcatacttggaccgggcgaatcaaaatcaatgagatcgcggttcggttgcacaagcaaaagcacccgcggatctttaagcatgaagccgacatgattaagtatttgaataagcatctaaccaaaaagaccgcaaataatgattaaatgaacatgaggacggactagcaaggtggctagtccgttttctattaggggcgagtaaaacaagttatgatagcaatcgaacgatttttaagcacacgtacgacacctgaaattgcggtgagcctactgggtaaacagttgcgcttacagacatctagcggtgtattgaccgcctggatcacagaaacagaagcgtatcttggtgcccgtgatgcaggagctcacgcgtatcagaaccaccaaacgccgcgcaatcgcgcactctggcaatcagcgggaacaatttatatttatcaaatgagggcctggtgcttactgaatattgtgacacaagctgccggtacgccagaatgtgtcttgattcgcggaattgaaccagatgcggggcttgaacgaatgcaacagcagcggccagtgcccattgcgaacttgaccaacggaccgggcaagctaatgcaggcgcttgggttagataaaacgttaaatggacaaacgctgcaaccggcgaccttatcattggatttgagtcattatcgccaaccggaacaagttgtggcgactccgcgaattggaattgtcaacaagggtgaatggacaacggcaccattgcggtactttgtggccggcaatccattcgtatccaagatttctcgccggaccatcgatcatgaacatcatggttggatgaccaggtgattgtcaagttaatcaggcttgttatataattgttactaagaaaaacgtgatagtcttaagcgatggcgcttggcgctctagctttcgatgggaggaaaatataaagatatgaaatggactgaagtaacggtcagtacttctaatgaagctgtcgaagcggtggcaaacattttaatggaagccggggccagtggcgtcaaaattgatgatgccttggattatcagaatttaaagcctgatcggtatggtgagatcatcgatttggcgacgattccacacgttaccagtggggcgaagatttctgcttattatcctgagacggtgtttgtaccggaagtcattccaacgatcaagcagcgggttagtcagctgactgattttgggttgaatccagcacctaatgaagtcagtatgacggctttatcggatgaagactgggcgacggcctggaaaaaatactatcaccccgtccgggttacgcgctatttgacgattgtgccaagttgggaacagtaccaaccagtgcaatcaggtgagcttgtgttgcgactagatcctggtcaggcttttggtaccggaacgcatccgacaaccaagctctgtttgcaggcgcttgaaactgtgatcaatggtggtgaacacttgatcgatgtgggtactgggtccggggtattgagtattgcggccaaagcgatgggcgtcggtgcagtagaagcttacgatcttgacgatgtcgctgtggcatcagctcaaacgaatttggacttgaatccagttgccaaagatgttcacgtggctgccaatgatttattagctgggattgacacgcaggctgatattatcgttgccaacattttggctgaaattattattccgttggtaccacaagcccgtcaaaacttaaaacggggcggctatttcattacctctggcatcatcgatgataagttccaggtcgtcatgacgacaattaaggaagcgggcttccaaattacacaacatacgcaaatgggtgactggcacggtatcgtggcttatctaccaacagctgaagattagtgggggactgaaatgcaacgatactttttatcaacaccgattacgacaacgattgggcaaacgttcactatcacgggtgagacggtcaaacactgggtcaaggtgatgcgcgcacaaccgggggacactgcggaattcgttacgacgacacatcaagtcgtgctggcggatttggtgaaaagcgatggtcgaacagctacagcgacaatcacggccgttacgacgccccatgttgaattgccgttgccagtgactattgcttgtgggttgtctaaaggcgataaacccgaacagatcgtacaacgtggtactgaattaggtgcgagcgccttcgtgtttttcgatagtcagtgggcagtggctaaatgggcagcgaataagcgggcccgcaagttggcccgcttggcgaaaattgcgcagggcgcggctgaacagtcacaccggacgatgattcctagtgtgagctacgcaacggatttaaaccagttgttagcacacgtgtcatatgataccggggtcgtagcgtgggaggaatcagccaaacaaggtgagagcagccaactggtgcagacgttaaaaacgatgaccgcaccacaacgactgctggcgatttttggtcctgaagggggcttggcaccacaagaagtggcgacattacaaactgctggtatcgcggcagtgggcctgggtccacgaatcatgcgggccgaaacggcacccctctacttactaagtagcgtttctttttggtgcgaactagtgtaattttgcggtcggtggtgtacaataaataatcatagtcatttagcaataaagcgtaagcgagggagttagtttgacggaaaaaattcgtaagtttaatggccagtattggctgattgcgcttgtcgttggggtgatgataccatggttgctacgatttacgagtattagccggtttcatcagattgtatggctactctttgtagttgactttgtgctggcagcagtcgttggctggtggattcgtcggactgaacggacgggctggttagtctggctattcccagtgggctgttttgtcgggctctatctatttttcccaacgtatgtctattacttagcgttagttgatttaggcatatcctacttagcatatgggttaactggtccccgcgcgagtttgcgttaaaacggttgtcaaggcacgttgggtgggaacctcacgtgccttttattaaatagaatctttgtggaagtcgtggtgataaaatgcccaaacaacctacctggactgcccaggatgtcctggacatggttcaaaagtatatgaatagtgatcacgtcgcgttagttaaacgggcgtgtgattttgcaacttatgtgcataaggatcagtatcgccaatctggtgagccgtatattatgcatccgattcaagttgctggtatcttagctgaattgaagatggaccctgaaaccgtcgcttcgggtttcttacacgacgttgtggaagatactggtgttactttaggagacgttgaagaactgtttggtcatgacgtggccgttattgttgacggggtcaccaagctgggtaagattcggtacaagtccaacaaagaacagcttgctgaaaatcaccgtaaattactgttggcgatgtctaaagatattcgagtcatgattgtcaaattagctgatcgcttgcataatatgcggacattgcagcatctgcggcccgataaacagcggcgaattgcaaatgaaacgttggaaatttacgcccccattgccgatcgattagggatcagcacgattaaatgggaactagaagatatttcactacgttatttgaatcctcaacagtattatcgcattgtccacttgatgaattcgcggcgtgaggaccgtgaaaagtacatcgagattgccattcaagacattcaaaaggcgctccatgatctggaactaccagaagctgaaatttatggtcgtccgaagcatatctattcaatttataagaagatgcgggacaaacacaaacagtttagccaactttacgatctgctggcaattcgggtggtcgtggattcaatcaaggactgttatgcagttttaggtgcgattcacacacaatggaagcccatgccggggcgttttaaagattatattgcgatgcccaaggccaatatgtatcaatctttgcataccacggtggtcggtcctgaaggtaagcccctcgaaatacagatccggacgtttgaaatgcaccgggtcgctgaatacggggtcgcagcacactgggcgtataaggaaggtaaacgcgacgaggtccaagagactcagtcgggcaacaagttgaacttagtcaaagaaatcattgagctacaggatgaaagtaaggacgctgccgactttatggagggcgtcaagggcgacctctttagtgaccgggtctatgcttttacgcccaagggtgacgtgacagaattaccaaagggcgctggaccactggatatggcatattcgatccatacggaagtgggtaaccatacgactggtgcgaaagtcaatggcaagatcgttccattggattaccaaatcaaaaatggtgatatcgtggatattttaacgtccactagttcaactggtcctagccgtgattggcagaaattagtctatacgcggcgggcccgtaataaaatcaaacagttcttccgcaatgctgaccgtgaggaaaacatcattacgggtcgtgatttgcttgagaagcagctacgtgatttagagtttaatccaaaagaaatcatgactaaggacaaggtgacggcggtcgctcaaaagatgcactacggtagtgaggatgatttgttcgcggccttggggtttggtgacgtccaaccggtagggattgctaaccggttaacgagtgatgttcgtaaacagcgcgaggctaatcggcagcgtgaacgtgaggaggccattttggcagactctacggaagcgccagcgaagaagaaatcgaaagatcatcataatgaggatcaggagaagcaggatcggaagcggcaaaaggtctcatcttctggtggggtgattattcaaggcgtcgacaacttactcgtacgtctaagtcattgctgttctccaattccgggtgatgagattgttggttatattacgaaggggcgcggtgtttcggttcaccgtgttgattgtccgaacgttaagagcgcagaagcaaatggtgaacggttgattgatgttcagtgggagaatcccgagggtgaccgaacgaactacaattctgatttggaaattcaaggttataaccgtaatggcatgctcaacgatgtgttgaaagttatcaataatcacacgaaatttttgaccaatgtcaacggtaaggtcgatcacaacaagatggtcattattagtgtttcgttgggggttcgcaacttggaacatctccaacgaatcattgacagtctgaaaaatgttcaggatctttacgttgtcgaacggaaaatgttttaggaggcttctatgcgagtcattgttcagcggtcacagcaggcacaagttagtattgatgggaaagttcggggcacgattgaccacggtttcgtcctattggttggttttcaagatggcgacggtcaagccgaattggattacatcgcgcataagattttaaacctccgcgtttttagtgacgcagatggaaaaatgaatttgaatattcaacaagtcggtggagcaatcttgtcgatatcgcagtttacgttatacgcggagacgcgccatggtaatcgaccaagttttacagcggcgggtaatcctgaattggctagcaaattgtatgatacatttaatcagcaattagctgccagtggcgtgaccgttgcgactggtgaatttggtgccgatatgcaagtttccttggttaacgatgggccggtcacgatttgttatgatactgatcaacgttgaagtaaaagctgaaagaccaatccggtactttcagctttttggctattacaattattagcgggagtgaatgagatgcgtgagtttttatgggacctcgatggaaccttgttagatacttatccagccatggtccaagctttccaaaaagcagttgccgagttaggtgggactattccggctgatacaacgtaccagctgatgcggcaacagtcagttggttatgcggaaagaatggttgcggctcagtatggttgggattggcatgatttacgggcgggctatcaacgttgggagccacaattacagcatgcaccggccgcctttgcgggtgctcaagcggtgcttgaaaaagttatcgcagttggtggtcacaattatttgatgacccatcgtgacgaaagcgcacaagcctatttacaacgagcgggtttagcccaatatttcacagatgcggtcacggctgctcagccattcccacgtaaacctgatccagctgcgttgaattatttattgaataaacaccaggtcgaccgtcaacgcgccgttatggtgggtgatcgcaacttggatatcgatgccggtcacaatgctgggattgccggatatttatttgatattgactgcctgattacggtgactagtgccccggaagttcaagttacggatttaaacgacttattgacctttgtcgactagtctagacactcgaaatattgtgatagctgatgattgtagctaaaaaattgtatacaagcctcgtgaccgagtcctctcaatgagctgcacgggtcgcgaggcttgtattaatattgcatgagaattcggtcaacggctggtccgtatgtttcaccaaagaggttcaggtgggccagtaaataatagagttggtagcttggtaggcggtcttgcataccgggcgcaaccgggtaggctgcttggtaagcctgataaaaatcagtatcaaaaccaccaaaaatcgtcgtcatggccagatccgtctctcggtcaccgtaaaacacgtcgggatcgatcaaaacgggcgtaccggtcgtgtcaaataagtaattacctgaccacaaatcgccatgtaacaggcttggttttaccgtgtgcatgtgggaatcttgcaacagttgttgtcgtaagcggtgataatgcatttcacgcgtttctgaccataaatggtgttccttagccaaattgactaatacatctaaacgttgttgtgtatagaaagttgcccaatcagtctgccaatgattaattttcggtaacttgccagctgtgaagtcgtggtcaagaccaaattgggcgtggtgttgatggtgaactttggcgacagccgctcccagtgcggactgactgccagtcccggtcgctagccaatctaataagagataaccgtctgtggcaatcgtgccactggcgatgacacgcggtgtcttagtcactgcaccaagtagtcgcaatccagcgacttcgtggtcaaagaaagtaacgtcgttgtgcggctgaaccttcaaaaaatattggtgatgacgggtgatgatttgaaaggccgcgttgatgtcgccaccgctcactggttgcacttgctgaatgtcagtgagtggtagttgtgcgagccaagtttttgttaagtgcatgttaactcctccttgctgcgatgttaaatacggttaccatcactgtaacgcaattaattgttattaacaattagtggcgttgatccgtaagagtgtgaaatgaggttagacgtccggtacggagctaaagtgcaggcaaatagacggttatttaggtaaaccgcgtcagttgatatgcgattcatcgattgaatagtcgcgaaaagtggccgttatcccagtcactggaataacggccactttcaaagacttcatgctgactgcattattattgattggcgaagtaggtactcaatccggcgtaaaccgcgtgcgctacttcttgagggtactttttagaactgatcgtcttgaagtccgacttatcattaatataacccagttccatcaatacggatggtcgtgaattatcacgaatgaccagaaagtcaccgaagtccgttcctttactaggaattggcaaggtcgagacgttattgtttaacgccttggctagtgctagtgaggttgacttatgatagtaataggtcgtgatcccagaagccgtgtttttttctggtgagctgtcaaagtggaagctgatgaaggcgtctgcatgaagcttgtttgcgattgcgggacgcgcactcaggccgacgtattcatctgaatcacgggttaaaacaacgtgtgcgccagcagcccggagctttttagctacagctttagcgacccgtaacgtgtacgttttttccatcttgcccttgctcgagagcgccccggaatcagaaccgccgtgtccgggatctaaaacgatggtggcttcagagattttggtggttttagtcaactgactgttatgttcgttgactaaccaactagcaatccagccgaatttatgatccgcataacggacgtatagccaattatttttgcgtttcataatgtggaccttggtgcccttagacgtagcgtcctcgatcgcataactcatgcctggaccgctacgaatattgacgttggcaatgttaacagtcgcagtgttattagtcgctaatagcactacaaagccaatcactaggccgataaaaataaccgtgactgtgatttgacgccaaaattgttttaaaacttgcatgctctgtcaccaactagatttaagataattgcaatttgaagtgctgcaaatagtataccaaaaaaacagctgaccgacgaaatcttgagataattttaactagaatcgttgacttttaagtgattttcgtgtaactttaaccatatattaatcaatcgaccgcagagaaagtaagagcattgtacgccactataaccagagaccggtagtgctgagaattccggatagtgcgcaatgaggagacgcttttgaggtgaacggcagcgttccgcctgtgattacagacgttatcaattagtactcaaaaaggtggtaccgcgctaatagcgcccttggtaaataatcaagggcgctttttttgtcgattgcaatcaagggaggaactattaatgagatatcaacggcctaaaggcaccgccgacattttgcctggcgatagtgaaaagtggcaatacgttgaagcaacggctcgtgccgtcttcaagacttatcaattcaaagagatccggacaccgatgtttgaaaatttcgaggtcttctcacgttcagcgggggatacttctgatattgtgacgaaggaaatgtacgattttcatgacaagggtgaccggcacattacgctccgcccagaaggaactgccggcgtcgtccgggcgttcgttgaaaataagttgtacggtccgcaagttctcaaaccatacaaggtttattacatgggaccaatgttccgttatgaacggccccaatcaggtcggttacgtgagttccatcaattaggcgtggaagcttttggtagtgaaagtgctgccctagacgttgaagtaattgcaatgggctataacttacttaaaacctttggcttgactgatttgaaactggtcatcaacacgttgggtgatcaacaaacgcgtgatgattaccgacaagccttgattgattatttggaaccacactttgatgaattgagtgatgactccaaggaacggttacacaagaatccattgcgggttttagatagtaaggcaccggaagatcaacaatttgtggccgatgcaccatcgattttagattacttgtctccggaagctcaagcgcattttgatcaaactaagacgtatttagatgcattagcaattccgtacgagattgatgccacgatggtccggggattagattattataaccatacgatttttgaaattatgacccactcaaaagcgttaggcaagggctacacgacgatctgtgctgggggtcgttacaacggattggttaaggaattaggtggccctgaagtttcgggtgttggctttggcctgggtgttgaacgactattagtgttgatggatgctgaaaacattgcggtaccaactgatgatcagttggacgtctatgttgtgggaattggcgacactgctagtgctacgactttgaagctggtacaggcattacgggcagccggttataaggccgaacgggattacttggatcgcaagcctaaagctcagttcaagagtgctgatcgcttgaatgcccgttacacgatgacggtgggcgaaaccgagctggctgatcaggtcgttaacttgaaggctatggctactggtgaggaaaccaaggttgcgatggcggacatctatcaagatgctcatcaagttttagataagtagtgtaaacggcaagtttgccgatttataaggaggaagcgtttatgaaacggaccacatatgcgggtctcatcaatgaggattatttaggccaaacggtcactttacaaggttgggtacaaaaacgccgcgaccttgggagtttgatttttattgatttacgggaccgtgaaggaattgtgcaattagtctttagtcaggaattttcagcggatgctttggcggtagcagatcagttacggggcgaatacgtcattgaagtgcaaggaaccgttgttaatcggaatgctgacgctgttaatgaccgcatgaagactggtaaagttgaagttgagattcacgatgccaaaatcttaaataaggcgaaaaccccgccattttatattcaagatgacattaacgtatcagatgaattgcgcttgaagtaccgttacttggacttgcgtcggccagaaatgcaacgtggattgaaaattcgtaatggcatcacccaagcagttcatagctattttgatgccaacgggttctatgatattgaaacgccgttcttaacgaagtcgacgccagaaggggcccgggattacttagtgccttcgcgggtctatcaagggcatttttacgcgttaccacaatcaccacaactctttaagcaattgctgatgggggccggttttgatcgctactatcaaattgcacgctgtttccgtgatgaagatttgcggggtgaccgtcagcctgaatttacccagattgatatggagacatccttcttaacggctgaggaaattcagtcctatactgaaggcttgattaagcaagtcatgaaggacgtcaagggtgttgacatcaagacgccgtttacgcggatgacttggcaagaagctatggaccgttttggttctgaaaagccggatgtgcgctttggtatggaactcaaagacatgggcgcggccgtttctaacgccggttttaaagtctttgataatgcactcgctaatggtggcctggtcaaggcgattgcagttcctggcggtgctgatcaatattctagaaagcaaatcgatgcgtacacggagtacgttaaacggtttggggctaagggcttagcttggatgaaggtcactgacgacggctttagtggtcccgttgcgaaattcttcaagaacgatggtgactttgaagccattacgagtgctgctgctgctaaaccaggcgacttattattgtttgctgccgacagtttcaaagtagtttctgacacgctgggttacttacggaccgcgattgctaaggaacttgacttgattgatcaagatcaatacgcttacctatgggtcgttgactggccattgtttgaatatgatgaaggcatcgagcgctgggtaccagctcaccatccattcacaatgcccaatgaagaagatgttcattacttgaatgatggcgaagatccacacaaagcccatgcacaatcatatgatatcatcttgaatggttatgaactcgggggcgggtcgatccggattcatacccgcgaattacaagaaaagatgttcaaggcattggacttcactaaggaacgagcccaagaacaatttgggttcttactggatgcccttgacatgggctttccgcctcatggtggcttagcaatcgggttagaccggttcgcgatgttattatcaggtaacgacaacattcgtgaagtgatcgccttccctaagaattccaaggcgtcagaaccaatgaccaatgcaccatcgcgggtttctgaccagcaattagctgatttggatttgaatattaccaatcccgtaacggatgatgaaccaaccgaataaaaatattaagagcgtccagaaatggaagttctttttaattagtgttaaatttatattaatatttaattggaggaattctcatggaaacagcaatttttgcgggtggatgtttttggtgcatggttcagccttttgatagtcaacccggaatcgacagtgttgtctcgggttatactggtggacacacgaaaaatcccacttacgaagacgtcaaagcgcatacgacgggtcatactgaagctgtcaaaattacgtttgatcccgatatcattagttacacggaattagtcaatatttattggcatcaaacggatcctaccgatgcaatggggcaatttcaagatcgtggtgataattatcggccggtcatttttgtgaatggtccggaacaacggcggatcgcggaagcgtctaaacgggcattacaggtgagcgaacgatttagtaaaccaatcgtaacggcgattgaggatgccaaaccattttatccagccgaggcacgccaccaacgcttttataaaaataatccagtggtatttgcggaacaagaagcgggtggccgcgctgattttatcgccgagcagtgggccgatgcacctaaagtggactaagcgtgagttgctggtcatcgcgataggtgtgatctaataataactatcgtagcggggctcgttctggaaattagtcggattgattaatgggagtttgctgagaaacgtgagacttttagcagaatactgcaaaagaccggccgtttgcgaatcggcgtgttacaataacgaaagcaaaaacgtaaaggagcacacttaattcatggatgattttcagcagttatccaaacaccatcgtgatgttgtgaaagcgtcaactgcttttatatacgccattttagtttccattgccatgaactacttttggacgccggggcatatttattcttcagggatcactgggcttgcacaattgattaatagtttgatgagcaagtttcttcccgttcagatttcaactgcggcgttactgtttattttgaatgttccaatgtttattattgcgtggcgatcgattgggcataagtttacgttgtatacgttcttagctgttacgctatctagtattatgatcaaactgattgccccagttggtttgacccatgaccccatcatttgtgcgatttttgggggtgctgttaatggtttcgggaccggaacggccctcaaaaatgggatttcaaccggtggcctcgatattatcggtatcgtgttacgccgtaaaacgggtcgcagtattgggacgatcaacatggcgttcaactcgatcattgtcattgcggctggctttgtttacgggtggccatatgccttttattctgcactcgggttgtttgtaaatggtcgggtcatggatatgacgtatacgcgccaacagaagatgcaagtgatgattattacgagtcgccctaaaacggtgattgatagcgttcaaaatcggattcgtcgtggcgttaccatcgtacacaacgctgaaggtgcttatcaacatgatgataaaacgattttatttacagtcatcacgcgttacgaaatgggcgaattgaaggcggccatggccgaatctgacccgcacgctttcgttagtatttcagatacggtcaagattctcggtcacttttatgaaccgaagccttgatgaatttatcagattaaaagtgtttgcaaacaggactttcgggacttgtttgcaagcactttttgattaggcgttcggggacgacttttacaccactattaatagtgacccgactagccgaagtgtgggcatctgttatataatacaagcattgtgttattgctggatcataagtccatatcagttagacccagagctaatgaacaactaatggggaacagacttgaaaaatagttgtttatatttagtggacgaaggcagacggctcaagtaagttgacgccaatctgaactttttaagcgtaattgagctggcacatttttgattgtcacgtagggcacgctttaccaataattaatgatgaaatgaaaggatggccagtgtgaagaaagtaatttatgtctggctggtgcgagttgtatcgtggctagcgcactttagcaaaaatgatcaggtgatttatttgatgagctttgcggacaatttggattttattcagcagttgaaccagcgcgttcccgggcgcttgactgtttattacttgccgagtgcagccaccggggcggcacaactggcacaggcgggaattgcgacacggccgtttcatgattcagttcgatttgccttgacgggaattcccgtcattacccgggcagcggacgtttatcttgataattattatggctttaccgctggcttgacgcggcaggccccacaacgactgattcaactctggcatgctgctggcgcggtcaaaacatttggttggggtgatccacagacggcacagcgacccgcagatgatcggcgtcggtttcagaccgtgtatgatcagattactgattacgtggttggttctgagaagatgggaacgatttttgcagcgagttatcacgtcccacagacgcggatgcgggtcttgggatatcctcgttcggatcggtattgtaagtccgactgggtgatgcaaactgcaacggccatttatcagaagtatccggcgtttaaacaacaggaagttattttgtatgcgccgacttatcgagccggtgttcaatttgcgttgccggctgattttaagcaattaaagttgcggcccgaccaacacttgattattaagttacatccccatttggccgagcaggaacgtgatttgcaagcccgttacccggacctagtgacattggtacctgagtttagtaccgatgaattgttgacggtcgctaatacgttggtcagtgactactcctcagttgtgtttgactacgcgttgttaccaaattgtcaaaaaatcgttttttatgtctttgactgggaccactatgagcaagaagtgggcctgcaagctgattttagggactgggcgccgggaccattagtccggacggtggtggacttgaatcatgtcctagcaatgccgggtgcgccgttacagttaacccagtttaatcagttatggaatacgcgtaatgacggtcatgcgattgagcggaccttggcgtacttttatacacgggtgaccacaaccgcttagaataacttgacagatttatttggataatgagtgatcatgccggtatcatatgtatccggcaactttaaggtatgacaggaattagtaaacttgcgaaaaggatgggactacaatgcttagattaggttcacatgtttcgatgaaggcacccgacatgttgctcggatctgccaatgaggcggcaagttacggcgccaacacatttatgatctatacgggcgcaccccaaaatacacggcgtaaaccaattgacgaactgaaaattgacgaagcacagccgataatcgaggctcatgacctccggcagatcgtcgtacatgccccatacatcattaatttaggtaatacgaaaaagccgggttattttgagtttgcaacggactttctctatcaagagatccagcgtgcagatgccgttggcgcaacacaattaacgctccatccgggagcacatattggtgccggagcggatgttgccattgcgcagatcatcaagggactgaacgcggttattcggccagagcagcacgttcaaatcgcgctagaaacgatggctggcaaaggaactgaagttggccggacgtttgaagaactcgcacagatgatcgacggggtgacttataatgaaaagttatcggttacctttgatacttgccatactagtgatgccggttacgcgattaaggacgatttcgacggtgtcctgaatgaatttgatcatgtgattgggctggatcgtttgaaagtgatccatctcaatgattctaagaatcctcaaggtgctcacaaggaccggcacacgaatatcggtatgggaacgattggctttgatactttgaataaggtcgcccatcatccacaattgccagacatcagcaagattttagaaacgccgtatgtcggggaagataagaaacatcaattgccaccttataagtatgagattgcaatgcttcgggccggggagtttaatccgcatttgattgaagatattgaacagcaacgttaatgagaattgaacgataatcgctagtcggttgtcgttttttgttttagaaggaggaaaatgacgatgcaattgaagaaacagcggctattagtgattggtggtacttcgggtttcggcatggcaattgctcgccaagccttacaggaaggcgccgatgtccatattatcggtcatacggcggcgcacgtaacagctgccatcacccaattaggcccatcagaccatttgactggaacggcgttagacgcacaaaatctggcgcaactaaaaactttttttgcagctcagcccgcatttgaccacgtcgtctcaatgttaggtggtgcaatgggtggggggttcttggacaattcgattgcagcgattcggcagacggttgaagataaattttttgcaaatctgcaagtggcccaattagccagccaccatcttaaccaacacggttcgctgatttttacttcgggtgctggtgggcggccagataatgcctccggagcgattgttggcaatcaagccattaatacgatggtcgttggacttgccgtagagttggcgcctgactatcgcgtcaatgcagttgcaccgacttggacgccgactggtctttggcgccaactatcggacgcacaattggcagcccaggctgcgaccgtcagtgctggtaatcccttgaaacgcgtggcaacgcccgccgaagtcgcgtcggcgtatgtttatttgatgcaaaatgagtttatgactgggcaagtgttgcacgttgacggtggtgtcgagctcgtgtgagtgacacgactgatgattagtagctgacctaattaatgataagaaaaatgatgcaaaaaagcgcgcgctgaccgttagaaggtggcacgcgctgattgtcaggaaaacttaggcggcatcggtgagttggcgattagtgatactagccattattagtgtcgtcagtattcaagctttcggtaattaaagtggcggtttcttcgattgacttattagcgacattgataactaaacacccaatctttttgaagatcttgtcggcgtattccaactcggctttaattttatccgtgttggaatacatggtgtcgggattaagcccatattggaccattcgctgccggcgaatatcgtttaacttttcaggatcgttagttaggccaaaaatctttttcggatcaactttccaaatttcgtcaggaatttgagcctgaggaactagtggcaagttggcgactttcaggttacgattagctaagtagagtgacaggggagtcttagaggtccgggagacacccagtaagaccacgtcggcctctaaaaagccactcggattcttaccatcatcgtaagtgaccgcaaattcgatcgcgttgatccggtcgaagtagttggtgtttaacgcgtgtacggtaccggggtgatttgacggttggacgtgcgtaatctgtgaaaaagtatctaaagctggtgtaatgacgtcataataaggcaactcgtgcgcttcgcaaaattggttaacgatttggctgagccggcgatcgacaaacgtatgaaagatggcggcgtgttccttcagtgcctgcgacaaaaccgtctggagcagtgagtcggtgcggacaaatgggaaacgctgatagcgaatgtcatagtcggagaattgtgcagcggcagctaaggccacgttatgagctgtttcaccgatagaatcagataaaataaagactttaattgctgacatagaataacctcatttcggttcgataatagtcttagtgtagcatagccggcgggggatgaaaacgatttactgtccgaactgacgttgcttttaacgatttattttaaggaaattgtaaactttggttgacggcctttttcaatttatgtataatttactagaacagttgtgttatgtgtaagtatgcataatttaacggttactttttgagctcggagggagggaatttaacatggcaaaaacagtcgttcgtaaaaacgaatctcttgatgatgctcttcgtcgctttaagcgtaccgtttcaaagagtggtactttacaagaataccgcaaacgggaattctacgaaaaaccaagtgtgaagaagaagttaaaatctgaagcagcacgtaagcgtaagaaccgtcgtcgtttcaagtaattagtattgattactaatgacctaacgaggagggaaaaccaatgagtttaatcgatacactcaatggtgatctaaaagctgcgatgaaggcacgcgataagcaagccctcagcgttatacggatgcttaagtcagcattgatgaatgaacaaattaatgttggccatgatttaacggctgatgaggaagtaagcgtgctctcacgtgaactgaaacaacggcgcgaatcattaagtgaattcgaaaatgcgggtcgtcaagatttagtcgacggcgttaaagcagaaattgcaattgttgagcagtacatgccaaaacaattgtcggacgaagaagttcaacagattgttgctgacaccattcaacaagtcggagctactggtaaaggtgactttggcaaggtgatgggggcagtgatgccaaaacttaagggtcaggcggatggcaagctgatcaaccaaacagttaaatcattattgaattaacggttaaccggagaaatttttctccggtttttttgtttcttctggttgatcagaaatgcagtaccggttgttcggattaagtagggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgctggttcttgataaagcttttaatattggtcattagctgaggactgacattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcgcaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagctttgcaagcacttgtaagcttccgttagtagcttcttgaacaactaaatcagtaatatttgggtctttaatttggagcagtactttagtagaatggtctagggacatatctgacactcgctttcaattggttttggtcgacttgattgtagcacaggacgatatgtccttttgttgtacataaaaatagtgttgatggattttatccatcaacactaaatatcatagacccattaagtatcagcaatgggtgcagggactgatctaactgggcttacgttgattgatagcgtgccaatttaatcgctcgaaagaaaaatgctgttcagaaaatcgttgtcgaatgtcgaggcgtccttgtactggttcgatgggggcttttatgctatgattaactaacaaatacctgctgaaatcagcgtggttatcacgctaactgcgggtgccattattaaataatggtgattaaatctgtcaataaaggagtccatgtttttgaccgaaaactcaaaatatgaacaaaaatttctcattgctgatccggcccagtcagtcgcgttattaggaccagaagacgcccacttagctttgcttgaggatgggttacacgttcaattgcacgtgtttggggatcaaatgacgatcagcagtgatgacgaggttgctgttcataatacgcaagcagtactagataatttaacgagtttaattaaacaaggtattcagattggggcgccagatgttattagcgctattaagatggtcaaccgggggactttggattactttaaagacctctattcagagaccttaattaaggacaatcgtggacggcccattcgtgtcaaaaactttggtcagcggcagtatgtgcaagccgttgctaaaagtgatattacgtttggtattggtccagccgggactgggaagacctatctagccgttgtgatggcaattgcagctttaaaacggggcgatgtcgagaagctgattttgacgcggccagcggttgaagctggtgagagtcttggctttctacctggtgatttaaaggaaaaagtcgatccgtacctgcggccaatttatgatgcgttgtacgatatttatggcgctgaacatacccagcgcttaatggatcgtggtatcatcgaaatcgcaccgctggcttatatgcgggggcggacgcttgaccatgcgttcgtcatcttggatgaagcacagaatacgacgaatgcccagatgaagatgtttttgacgcggctaggtttcggtgccaagatgattgttaatggtgatatctcacaaattgatttaccacaccatactaagagtggcttgattcaagccgaacagattttgggcggcattagcaatgtcgcgttcgttaagtttacggcggatgatgtggtcagaaatccggtcgttgccaagattattacggcgtacgaccgtgtggaacaacgctagggggcacttatggatttagaattatacgaccaaacaacaacgggagcgcagccagaacagttgcaattgattcgggatttaattgatcttgctggtcagacgttaaagttacgggatgatactgaggtctcggtgaccctgatgaataacgatgctattcaaaaaatcaatgaacagtatcggggtgtcgatcgtccaactgatgttattagttttgcgatgcacgacgatgacgaggatgatttgattgtgatggatccggagatggcggcggaaatgccactaaatctcggggatattatgatatcagttgataaggttagcgaacaagccgcttttttgaaccattcggaggcgcgcgagctaggttacttggtcgttcacggctttttacatttaaatgggtatgatcatcttcagccagcggatgaaaccgaaatgtttacattgcaacgccagattttggacgcttatggcctcgaaaaatagaccagatcggctacaggttggcaaaaatcactcgttttggcagtcctggctacacgcgtggactgggcttaaaacggttgtgattgaagaacgtaatatgcgaacacaccttgtactgggggcggtggccttgtttgctggctggtgggttcacttgagcgttaacgaatggctgtggctagcattagcgatttttctggtcatcttatgtgaaattaacaatacgattgcagaaaacctgtccgatatgatcactgggcctaatttcagtcccctagctaaaaaaattaaggacattgcggctggtgcggtagtgtttgccgcggcctttgccgtcttagttgggttagtgttgtttgcacctaaaatttggaacttaattgtcagttggttaaactagtaattggttaacgattggacaagattgaaaggaattaattatggcagaacaacaagcatttcattccggctttgtggcgattattggtcgtcccaatgtcggtaaatcaacactattgaatcgggtcgttgggcaaaaagtcgccattatgtctgacaaagcccaaacgacgcggaaccgtatccaggggatttataccactgcggatacgcagatggtcttcattgatacccctgggattcacaaaccgcatagtcgattaggtgactttatggtcaagtccgccttgtcaactttgggtgaagtggatgccgtactattcatgattaatgcggacgaacggcgtggtgccggggataactttattatcgatcgtcttaaaacggttaaacaaccgatttatttagtgattaataaaattgatcaagtccatccagatcatctcttggagattatggatcagtataaagacgctttgccgtggaaggaagtttatccaatttccgcgcttgaaggaaataacgttgatgaactactgacgaccttgaagggccaattgccggaaggaccgcagtattatccgtccgaccaaattacggatcatccagagcggtttatcatttctgaattgattcgtgaaaaggttcttgaattgactcgtcaagaagttccccattcaacggcggtcgtgattgattcgatcaaacgtcaagatgaagaaaaaattcacgttcaggccacgattattattgaacggtcttcgcaaaagggcatcatcatcggtaagggtggtagcatgctcaagaagattggctcgttagctcggcgtgatattgaacacttacttggggataaggtctaccttgagctctgggtaaaagtccaagagaactggaaggaccgtcaagacttgctagccagctatggctatcggcaagatgactattagaatcgctaggtgatccggatggcccaacaaatggtcacgaattttaacggcattttgctctttcgccgggactaccgggaacgcgatatgctaatcaagtttttaactgccgagtatggcaagaagatgttttttatccgcggtgcgcgtcggcgtggcttcaaaatggcggcggagttattgccgttcacgatgggggaatacgttggtgatttacgtgatcaaggtctctcgtatattaatagtgtcaagtcagtacagtatcttgaacatattagtcaagacattgctttgaacgcttatgccacgtacgttatgaacttaatggacgtcgcttttccagataatcaaccggtggggcggtggtaccaacagttgaccagtgcgctgcaactgattgatcaagatgtggcccccgcgttggtggctaacgtggtcgaaattcagttattgcaaccgtttggggtggccccagagttgcgttggtgtacggtttgcggtcgaagtgatttaccgttagattattctgaaagttacggcggtttgctctgtcaacagcactggcatttggatccccaccgcttgcatgctagtccagcagcgatcttttatctacgtcagttttccgtgttggatttggctaaggttcattcgatcaaggtcaaaccgcggacagcggcggagttacgccggattttggatgaaatctatcagaactcagtgggcgttcgattgaaatctaaacgcttcatcgatcagatgggcagttggtaccaaccgttggcgccccggaagaatgaggattgacaaacgaacgaccatcagctatgatgatgaagaactgaatagttaagtgttgatgagagaaggttaacggattcgacttacagtgagaccgtgatggtgaaaaacggtcagtcaaagttgttaattggcgctttcggagctttaataccgtgtaattaagctgctgaggttactcagaagtagggtggaaccgcgaaaccaatcgtccctatgtcgttattgtcgacgacaggggactttttttgtgccataagtctgggaatagcgatgcccccgtttcaaagccatcagccgttcagtcactaattttgggaggatactaatgagcaaaaagttatcagtgcaagagattatcttaaccttgcaaaagttttggtcggatcaaggttgtatgttaatgcaatcatatgatacagaaaaaggggccggaacgatgagcccctacacgttcttacgggcaatcggtcctgaaccatggaacgcggcgtacgttgaaccttcacgccggcctgccgatggtcggtatggtgagaaccccaaccggttgtaccaacaccaccaattccaagtggtcatgaaaccctcaccagaaaacgtgcaggatttatacttacaaagcttggaaaaacttggcattaacccgctagaacacgatattcgtttcgtggaagataactgggaaaacccatcaatgggttgtgccggtgttggttgggaagtttggctcgacgggatggaaatcagccaattcacgtacttccaacaagttggtggtcttgaagttgatcccgtcacttctgaaatcacctatggtttggaacgactctcatcttacattcaggatgtaaactccgtatttgaccttgaatggggcgatggcgtgaagtatggcgacatcttcttggaaccagaatttgaaaattctaagtacgcttttgaagatagcaacgaagaattattattaatgttatttgatgaatatgaaaaggaagccaagcggcaaattaagaacggcttagttcaccccgcgtacgactactgtcttaaatgtagtcataccttcaacttgatggatgctcgcggtatggtttcagtcacggaacgtgccggctatttagatcgaatccgaaacatggcgaagtcgattgccaaggaattcgtggcgcaacgtgaaaaacgtggcttcccgttattaaaacacgcacaggaggagacgaaataatggcgaaaacttatttacttgaaattggtttggaagaaatgccggcccacgtcgttacaccgagtgtgttacaacttaaagaacgaatggtcaagttcttaaaggatgcccggcttgattttgaagatgttaaaaccttctcaacaccacgccggttaacggttcaggtgttaggcttagctgacaagcaggctgatgtgaaaaaagaagttcggggtccagctaagaagattgctcaggatgcggatggcaactggacaaaggcagcgattggtttttctaagggccaaggggcgtcaactgatgacatcgtctttaaagatgttaagggtaccccgtatgtctttgtacaaacctttacggccggtaaaacggcggccgaagtgttggcggccggaatcaaggatgttatcaccaagatgaatttcccaacgatgatgaagtggtcgacgtacagtttcaagtatattcggccgattcgttggatcgtgtcattattagatgacgaggttgtgccggttcaaattctggacgttgcggctggccgtgtttcacgaggccaccgtttcttgggccatgacgttgaaattgctactgctgcggactatgaagctgacttagctagtgttcaagttattgcggatgccgctaaacgtaaggcaacgattcgtgaacagatcgcagccttggcgaatgaacgcgactggcaaatcaaagttaatgaagacttgttggaagaagttaataacttggtggaatatccaactgcatttgcgggagattttgataccaaatacttaacgatcccggatgaagtcttgattacttcgatgcgtgatcatcaacggttcttctacgtaacggatgccgaggataacttattaccacactttgtttccgttcgaaacgggaacacggatcacttggaaaacgtggctttaggtaatcaaaaagtattgacggcacgcttagaagatgcagctttcttctatcatgaagatcaacaacactcgattcaagaatatgtggaacgactcaaaaaggttagcttccatgataaaatcgggacgatgtatgagaagatgcagcgggtcatggttatcagtgattttttggctgatcggtttggtttgactgagactgaaaagaaccaactccaccgggcagcgcaaatctataaatttgatttagtgacagggatggttggcgaattccctgaattacaaggggtcatgggtgacaagtatgctgtcttgaagggtgaagatccagcagtcggtcaagctattcgtgagcattacatgccaatcagcgctgatggcgacttacctaagtccaaggtcggcgcggtgttagctattgcggacaaagttgattccattacgagcttctttgccgttggcttgactcctagtggctctaatgatccgtttgctttgcgtcgtcaagcgtttggaatcgtacggatcgtacgggaacaaggttgggatttcccaattcgtcaactcgaggccgatattcaaaaggaattagtggcccatgatgctacgtacaacttagacttcgaaaagcaaacggcaccagttgctgatttcttaacggatcgcgtcaaacaatggtttaacaaccgtaagattcgctacgatatcatcgatacggttatcaaagggagtcgtcaggatatccgtgaaatgttcaaagcagccgatgtgctgaatgcgcatcaagatgatccgcagtttaaggacacaattgaagcctttactcgtctgttgcggatcacggcgaaagctaagctggcagccggtgatttgactgttgatccaagtttatttgaaaatgaagcggaacaacacttgtacgatgctgttcttgaattgcaaaagcaatttaccccagcgatgagcatggaggaccgtttcaaagccctggccgccttacgaccattgatcgtcgattactttgaacagacgatggtgatgagtaaggatgaaaaggtgcgggataatcacttaaagcaactcttgacgatcgcccaaatgatcaacgtgatgggtgacttgaatcaattaatcgttaaataagcacggactgtggataatcaaaagaagttacagcaagcgcgctgtagcttcttttttagcttgctgacaaacaaatttgacaaatgtgtctaataggggcaacttattattgcactgctgtcaaacttgtggtaatatatattctgtaaaagtttgcacgcacaaagtcgcatccaaatttcgtgatgcggcttttgactgcggcaatgatttggttggtttgtcagactttagttagtagaaatgggggtggcaaagtggccaatcgaattcccgaggaaaaggttgagcaagtccgctcagcagtcaacattgcggattttattggacaatacgttcagttgaagaaggctggtaagaatttatttggcctgtgtccctttcacgaagagcgcacgccatccttttcggtcaatgagcaaaagcagatttttcactgtttcagctgtggccgtgggggcaacgtgttcagcttcattatggatctcgaaaacttgtcttttccggaagcagtcgtcaaggtggccgattttgggcacattgacttgccggcgagctatacggcgcagtcacaaccggccgcacctaaggatcagcaacaagccgatctgttaaagttgtactcggatagcgctaaaatgtatcaacatattttagtgaatactgaactgggtgaaccggcgcttaagtacttgcacgagcgtgggctggatgatgagacgattaaaacgtttggtatcggctatgcacctgctaatcagctcttgttagatttttttaaagaacaccagaccgactaccaactactacggcagtcgggactgttcattgaaaatcaagcgggtgacttacgtgatcgcttcgttgaccgggtcttgtttccgattaaagacgcgagtggtcgggtgattgctttctcaggtcgaatcctcaaaaaatcacctaatgaacctaagtatttgaatagtccggaaacgaagctgttcaacaagcgttcagtattatttaactttgacttagcacggggccccattcgacaacaaaagtcggtggtgctgtttgaaggttttatggatgtgattgcggcttatcgttctggtattcagaacggggtcgcatcaatggggacgagcctaactgatgagcagatttacatgcttgagcgcgttaccgacaccttatatgtctgttacgatagcgatatgccggggcaaaaggcgactgatcgtgctctgaaattgctaggtggtaacagtcgccttaatctgggtgtaatccaaatgcctgatgggatggatcccgacgagtatttgcgtgctcaggggcaggagaagtttgtccaagtatttgaagacggtaagcaaacgcccactgcatttgaaatgcagtatttaaaacatgatttgaacttgcaaaacacgcccgatcaattgacttatttacaggcggttttgcaacaattagcacaactgtcctctagtgtcgaacaggatttatatttaaaccaattagtggcggagtttgatcttgataaggatgatttaaagcaacagttacgatcactggtcggtcagcaggccgttcgacgtggtggtggtcactcggatgaaacgcaagtagctccgccaccagcacctgcgccgctagggcctcccccagccacggtggatggcagtacgaacagtggcccgttaagtcgggtagagaaagcggagcggttgttactgtaccgtttgttgaatgaccacgatgtttggttacgagtgatggcgattgctggttttcattttgttcatgattcgtatcaacaaatcttggtgtatgcggaggcttattttaaaacgcataatcaatttgatttgggcaactttacggattttatgacggattcagatttacagcctgtcgtcacgagtttggaatttatggacgttgccaatgaatcttccaaggaagagattgctgatctagtcaatgtgatcatgaatcaacagccgctggtagaacaaatcaacagtaagaaggccgagttaatggcagccaagcagatcggtaatcgtgatttggttcagcagttaacgttggcattaattgacctatatcggcaacaacagcaggtccaacgagctgataactaggcgtgaaaatgatatacttaaggttggctcggtattgcaaccgatcagctggtagatgcatactaaataggaggctactacatggcaaaggcaaaagcaacgacggaatacgacaaagccgttaaagcattaattaaggaatataagaaaactggtagcattcaatatgatgaattatcagataaattagcagcgccttacaaactagatgctagtggcattgataaattattacaaaaggttgaagatgctgggattagtgttgttgatgaaaaaggtgatcctgatgctcgagcggtcaaaagtgtcaaaaaagtttctaagaaggaacttagtgacgctggctcggcttctggaattaaaatcaatgatcccgtgcggatgtatttgaaagaaattggtcgtgtcgacttgttaacggctgacgaagaagtcgctttagcactccgaatcgaacaaggtgatgaatctgccaagcaagaattagccgaagccaacttacggttggtcgtttcgattgccaaacgttacgtgggtcggggaatgcaattccttgatttgattcaagaaggtaacatggggctaatgaaggccgttgaaaagtttgattaccgtaaaggattcaagttctcaacgtacgcgacttggtggattcgccaagcaattacgcgggcaattgctgaccaagcgcggaccattcggattccagtgcacatggtcgaaactattaacaaattaattcgaattcaacggcaactgttacaagatttagggcgcgaaccaactcctgaagaaattggggctgaaatggacatgccaacggaaaaggttcgtgaaatcttgaagatcgcacaagaacccgtttcattggaaacgccaattggtgaagaggacgattcacacttaggtgacttcatcgaagaccaagacgcaacctcaccagcggatgccgcggcttatgaattgttgaaagaacaactggaaggtgtccttgataccttgacggaccgggaagaaaacgtcttacgcttacggttcggacttgatgatggtcggacccggacactggaagaagttggaaaagtcttcggcgtgacccgtgaacggatccgccaaatcgaagccaaggcgctacggaagttacgccacccatcacgtagtaaacagttaaaagatttcttggaataatcaccagatgatgacgtctgactaaccagctaaaggtgctgattggtcaggcgttttttttgcttatgtagatgttaaaacgtggtggacactgatttaagccgcaacccacgtcttaatgccatattgacgaaacgtgttcgggtccgatgagccttccgggtagcgacgcgatgagtttaccgcttaacgccttagttgggctaatcctcagtctcaagccgtctgaaccacacactctggcagtgctgagcattggccgaaatgccttccagttgggaaggtattcgaatggctgacagggatgtccccaacttttgctggcttggtcgttgctattttagagacagcaattttatcagtaactgtcagtttgataatcgaactgtgattcgttcattaattctcagtcaccatattatgactgagattccaaacaactgagaccacattaacgtttgttcaatgttccaagcagtaattgaattcggcgaccaattgcactaagttgagtggccgttcatctgtcatgcgagcaggggtcccggaggtcggaataggatgaacaagcactgatgaactggcaaccaaatttaagactcttttcagtaatttggcatactgtaatgatgtcgcactcacgtttgaggtaatcattttgtgccaggaatatgattgttgagttgtcaaactcaaattagtatgttagtgtactagttgtagtaatacacgtagtacacaataccgaggtgataaaatgccgtttgcaactaatggggcaccgtattacgaacagttagttatgcagattaagcagcagatcgttcaggaagtcttacgaccaggggatcaattgccttcaattcgagcaatggcgtcagaaatgcaccttaatccgaacacggtcagtaaggcttatcaaatcttggagcatcagcgagccgtgtatactgtaaaaggtcgggggacgtttgtgagtgaatcgagtcagattgcaactgattcgaatgcggttgatgatcttcagacgcgcttacaatcactgttaacggaagcacaatttttaggaatcagtgcgcagcaagttcaggcgtgggtgaccacggcttatcaaaagggggagtcacgggatgagtatccaagttaaagcattaagtaagcggattgataatcgtgaaatattaagggggattacttttacttggcagccaggtcgaatcgttgggttggtcgggcggaacggcgttggaaagacgacgctctttcggacgatggctgatcactatttggcggacgaaggcgaattagtgattgaggggcagtcgactttgcagcaaccatactgtcggcaaaaattattttatattgatacacaacgtcacttttttggtggtcaacggttgcgacagatcataacgacatacgcgttggcttacgatgactttgaccaatcgcaactaacagcgttattagcggccgagcatttatcaaccaaaagctactaccagcggttatcaaagggtcagcagatgttatttcaaatcttgctagcgttagcgagtcacgtgccatatattattttggatgagccgtttgatggtttggatatcatcgtgcgcgagcggattgtagcctatatggttgaggaggtcgccgaacacggcgtcagtttcttgatttcatcacataatcttgatgaacttgacggtttatgcgaccaagtgctgtttttgcaacatcatgaattagttgctgattacgacctagaaagtttacgggcaacggcccgcaaatttcagcttgtttttgcagataagcatataccagcggttgtgaaagagcatgggcagctgattaaagtttacggtcgggtcttagaagtgtactttgcggactacacgccgacaattgagacagcgctccaacaaaatcaaccattgatgatggccgtccagccgttgaccattacagatgttttccgagttaaattgggcgaccggcaagctgtttggggtggtgtgtagaatggcaactgtaaaattgagacggttatggtggcaacaaaatcggccttgggtgcgacttgtgacggcaacgtgtctgttagtgagcttattaatggcaattaatgtgacacatacttggcaggtggaacatgcccggagtgtacgtggtgaacggatcaacgctgcagattttgttaaacacccgaaagactataaagttgccggtcgtccggcggttagcctgcatgtttattatgaacatcttgaccagtttttttggcctggcgaatacacttctacggatcccaatcaggcagtgcgggcccaacaacccaaccgtttgtattatgttttgggactcgtcagcggtttgctgcttgcattctggggtcgtcgcacacaccgcttcgagtttatggctggtttaggtgttacgcgttggcaaatttggtggcaacagctgcggctcgggctgctattaatggtcaccgtttttgtaagtcaagtgatttattatggctggatcacggctgcaatcccccaagtttatcagcaataccgtaacggggccgccctcttgggaagtagtgtggcagtgacgatggtcagtgggtgcctaattatgcttgcttggctggtggggagctttaatcagcggttatggttagcaatcctgatcagcactctgacctggcgttgggcgtcgggaatgttaacgcggacaaatatgtggttgcggtggtttcacattcagtcgttgcctagtatctggttacatgttcactacggggtagcggcaatcatggcattagtgggcttgctgatgctactaggattaacttgggtggcctgtcgtcaatggtcagcggatatcaccacattgcggcaacaatcgctatttaatggggttatcgccagtgctttgattagtttgagtattggctcaacacttggggacatcctactactgcctttgatgggaacaattgcgccgtggtatgaattggtcggaatcgtgctgactatgatggcactgctcgtctatcgtgttggccgtcgttaccatcaactgggggaagttgtgagatgaataaaaaattggggcacttgattatttggcagcatgcgccacttctcattggtatgctgattttgtttatagcactgggggcgtggactggcttcagaatgaatcaacactggcaaatgctagatcagaatcatgacatgctaatttcaggtcttaaatacgaccaccggcggcaacagtatcaggatgtagatggcttagtagcaccttcgaaacagcagtacttgaatcaatatttacaagtttatcatgctgatcggcggggattattggcgaatttgcgcgttgggagtaatgttgaaccaaatgattttctatggggaatcagtattttagtgggcatagcactcattgccattccacgttaccggcatcagaatgagtggttacagagcttaggatttcgccgagcagctatttttggtgcgacgtttttgagctatagtttaacgacgatcattgcgtatagtttggcgaaattaatggttctgctggtgctggtacagaatattcccggaatttatttcgcgcaattcaattggtgggtctggggcggcaatgtaatcagtaccacgctcgttgcactgattttgatgaccgcttctgcattagtgttattggtcacgcctaacctggtaatggcaatgctcgtcggctatgcaatcgttaaaccaatcagttggtttgtattgatacggtcattcggtcaacctggtaattatttgttggcgttcctcaatcaacactggttgttgggtatcgcaattggatgtctagtctggggcttgggcgggatacttggtcggtatttgagcgcccagcaaatcacggagcgtaaccaccaagcgattttgttaccggcttggcgggtaccaatgctgatagggttgagcatcatactgactaaattgattaccgacgttatgctggcaccacagacgagttggtcatatgtagcagtagtttggtcagcaacattaattggtctgattgcttggatttatcaaccgcgctggagtcgctacttttggcaagttgtgcgacagttacgctaatatgatgaaattaacaattaatcgataaagcatccagccggtcagtaatcttatttgaccggctggatgcttttaaacgttacgggtttgaaaagaatagttggcaagcgttaagaataacagtagataggcgatataaccaatcgccagcgtggatagatttagtcgggttaattgttgtagttgtggtgtttggatttgctcgcctagattgatcatgttgagcggattccactttaaccagctgactttggcgtataaataaaaacaaagttgattgaaaatggtcacaataaagtacccaatgatgccggtcagaatggctggtgttgaactggtgaatagggtgcccaatagtaagacgacactcattaaaaatagtagggtcagtcctgttgatagcatgttcagaccccaagtgtgccaaattgtaccgtaattaggtaaccgccgaaagaagctcaacttcagtccgagactcatgagggtgctaaagccagataagccaatcatcagaccgagtatcgtgagccatttgctgactaagacttgggtcctcgaataactgcgataaagtagcgctcgtaacgtgccattttgccgttcattcgttaaataagtgctgccaattgtgattgccaaaaatagtagcggaataaagccgtagtcgttgtttacaaatgcatcatatggcgttagtagctgtgggtagtgagcggcatatattgcaattatgaattgaaaaatcattataaatggaataaacagttgaatcacacgatggtgcattaattttcgattttcttgtcgtaacaatgtgaacattagattgacctccttagtggttgaccgttttcagcatggttaataaggatgattctaagtcttcagtgtggggttgaatccgctgtaactgaatctgattggtcaaaagtagttgcagtaatggattaagctgaaatccgggcgttattaagacacgaattggtgttgctgcaactaggtggtatccagcagaacgcaatagctgataagcccgttgatcttgattagttactaattcataagtggggcgctgttgggcaagaaacgccggcatgctcatattggcgatcagttgcccgtgatcaagaactaagacgtcattggcgacccgttgcagttcactcaggagatgacttgaaattaaaaaggtggtgccttgagcttgcgcccataaaattaaatcgcgtaattcttttgtggcctgtggatcaagaccattcatgggttcatctaagatgactagtgcgggctgattgagcaaagccaaggctacacccagtttttgccgcataccgagtgagtagtgtttcgttagtatatcggcaaatgcttgcatgctaagtgcttcaatgattttggtaacgcgtgctgtacgattggcaccggttgcgaacagtgagagttgttgccggccagtcaagaatgggtagagtccgggatattcaattagggcgcccacagcgcttaaagcttggtgatggcatggcgtaattgactgaccatttaaataaatctgaccagtaaaggaagtgagccctaagattgatttcatcagtgtcgttttgccagcaccatttgcaccaactaaggcgacgatatgccccttttgaatggtgaaggtcagggcttttaaaatgtgctggtgactgaagtattgatttaattgcgtgacggtcagtagtggtgtgttcatattggaatccccctaaaccttaagcggctaataataaccacttcaaggtattttacaaacaaagtatactattaatcatagcgtaatagtgtggtattacactatttaatataatcttaattattacttgttgtactcgttattatttagcaataactatggttaaaacgtcttgattttaaaattcagcaactgccggcttggatcaaccggaaacagtttgagtttgcaccaattttcggtggattcttaccgcgccaactttcagtcgtgatggtactcggattcaccagtattaataggacaatatctaaagataatcgatgataacttaagttttaattgcagtgccaggtcaaaatattcaataaataattgtaccaagttaggcggccatttgagtggcttaccagtcaccaatgttcacctgcattagtggctgaaaaaattcgggcactggtagactaacgaattggcgtgaacacaagccaaaaaacacgatcactagccagtgaccgtgtttttatttgataattctggaaattagttgttcgcgtcagcggctggtgtcatccaatcaacaaatcgatttgcatgttcggtaaagaaatttacgagtcgcccagttaaaaaggctgcaatgagggtaccttcccgaacccccgctaaagaatgagtaaagctgagtgccaggactagtgaaatgccaatcagaatgaaatcattataaactttgactttggcaaacttgagttgatgcatcagtgcgatggcgttcggaagtccttcaccaggcatgataatggcgtgtgaattgacttctaaaaagacacctaacgataagagcaccgttcccattaagacaagtccgagttgctcgatgtatgtttgattaggaagactatggaaaaaccgcacaaaagcatcgatgaaccaaccgaacaggctacccggaattaattgtaataagttttgccaggagaactgccggcgcaaaacgatggcttctagtagaactaaaatgaaaataaaagcaattgtcaactggccaattggaattgccgtaatattgctaatgacattcggaatacttgaaattggggacgttcctaataaggataatttagagagtgcgacgccagctgacatgcacaggataccaattacgaggactccaaagtgtttaatgaattttttcaatgacgatttcaatctcttttctcttgtaaggcgaggtaaacttgttgtaattggttcgtaaacacttgctcgttgacttctggatgagcagcgaagaagtcatgccaccagtcaatcaatgttttcttaatggcgatagcaatttgttcaccagccggtgtcaagttaattcgtagactacgctgatcggcaggatcacgaaaccggatgacgagttggcgttgctcaagttgacgaacagttcgagctaataaactaggatcgagcatcagactggcagccaagtccttttgagtttgggccgggtgatcgtaaacaaccagtaataagtcactttcggtcgcccgaatgttcagcgcctgtagttgggtgttgatgctgtttttggattcgcggtaaatacccgcaatatatttagttagactaaaatactcgatagtcagcactcctttttttataaatagtggacaagtccattatttataaaaaaaacgaccttgtcaagtcagtcgtttaatgggtcacagttgtaagtcatagttaatagtggatatggacggccctgatcatcagttggttggcgattagtgacttggaaaccacggtgttcataaaattgacgcgcccgtgggttttgttcattcactgtaagcgttgtggcaccataatcctgaatactagtttgcagtaaggcggttccaataccagcgccactagcggctggggcgataaaaagcatggctactagtgaaccatcaataccgatgaaaccagttggggtattttggtcatccactgcaacgagcagttgtggaacggttcgtaatgctgtggggacttcgtgctcaatggttgtgatttcagcgggcgttagaaagtggtgactggcgtcgacggactgtcgccagagttgagttaattggctaatcaattgcggtgttcgctcggcaggcgggaaagacttaattaacaatggtcgacctccttattttcgttgtgattgattaagtttaacataagagccggtgtcagtgccaaaactaatttaacggttggaatgacctttgaatgtattgaacttttgatggactaatcattttccaactggagaatggcggattaaagacatacatacgtaggcgagtaacaactaaacgaagtgaaatcacagttaatcagcgaccaccctcagttaggaatggcagatcaatcgacattgtattggctggctcgtatactagcgaaaagtggattggatgtgttggaatgaaatttgtaatttttggcggtgaattactggtgttagctgcctggctcatttatggtcgaacactgccattgagtttgcgtatcattggtgttattggaatcgttatcgtttcgcaattggcacattgggtattgaaagcacggtaactagcgttattaattgtgattcaaatgagcttttgatgtaaatccagaagctcactttttgtctgggttattttctaaagaattatgctaacttatcaatactgttgaaataatgacatttgtcacctgatcattatgacaaacgcgactactcgacccgattacgctggcgtacactatagtcattaaaggaggcggggataatgacaccgttgattgaagcaactaaggtcgcatttagttatggtcaacagtccgttttgactgatattaatatgacgatcatgccgggcgagattgttggcttgattggtgaaaatggggccggcaaaacgacgttgttaaatttgttattaggaatcaaacgagttcagcagggccatctcaaggtgttcgggcaagcggccggtagcctggcggcgcgattaaagattgggtcaatgatgcagggtgatatggcaattcaaggcgtgacggtgcgtgatatgttaaggctagctgcggcacaacgtctgcctgaatttgattggcaagcattattagccaccttgaaactacaagacatagcccagcaacgcttgacggcgttatctggaggacagttacgacgagtcacctttgctttggcactggtaggtgatcccgatttgttatttttagacgagccgaccgttagcatggataccaatgcgcaacagacattttggcaacagattaggcgcttgaaggccgctggtaaaaccattatcattaccagtcattacctaccggagattgaagccatcgctgatcgaattatgttgctgaaggacgggcgctttgtctttcaaggctcgtttgccgtgttgcaaaaacaatatcaacaagtggagattcgttgccaaacgagactgccagcggatcggtttacaaatttaacggcagtaactgcggttactaagcaaggcgacgaactacgcatgagtagtgaagacggtgacgctacgctgcaagcgatgatgcccataatcagtgagttgcatcaagtctcaattagtcgtgaatcattgacggatatttttgttcatctgacgaagggagtctcagcatgaaaattttaatggatcaactgagatttgatgcacggcgtttgattattcgaaacgcagcgtttcagttttttgccttggtgatgccagcagctttttacttgttatttacaaaagtaatggttaccggtggcacaacggctcaaatcgcactttttaatcggtcttatatgggcagtatgatcgtttatagtgggacaatcagtacgctgttcagtattgcccagattctaatgcatgatcgggaacggggactattacggtggctacggttaacgccacacggggtagtaccgtactatcgttcgattggcatgatgagtttgggaatgaatgcgttaacggtcgttattttaggcgcgcttgcggtcgttgtgaaccacgttgatttaactgtgtttcaatggctagggatacttggaattgccctgattggtcaattgccgacattgcttatgggcgttggactctcatttttgaatcgtgccgaaacgttgagtgtcgctagtaatttaattacctttccaatggccattattagtggtctatggtggcccattagcctattaccaagctggctacaggtgattggtaaacgactgccaacatattatgtgaacgatttgttggtcaactggggcacccatggtacactaaaattaatcgatttgcttggtatcgggctgtgggtgtgcggcctattagtgattgttagttgggtgattcagcgggtacttaaacgggggaatggcgttgttgacgcatcataaaaataaattgaagacgattgaatggacgagctacgtgtggctcgcctatttgccgtatacaattgcggcttatatacccgttaaatcttggcatgattggttttggctaatgttagttggtggctttcttgtattgtacatcttggttgttgagaagccgcattggcgtgcagtgacgatgccggcggagttagttgtgacgggactgtttgcggtatttgcggctaacaattttatgatcatctttcccggctggcaagtgagctttttacttggtcgtcgtcctaaacgagaattttatggttttgctttagggtattatgcctttttaattggtggctgtatacgagactatttacaatattctggtgtgtttgggtggcataatggtgacgtgatgggcttagtttttccattgttatcacccatactcgcgtataccttttcgcggtcagttgaacgacagcgccaactcaaccaaactaaccgccgattaaaaacaattgtggaacgtaacgagcgtgaacgaatcgcgcgtgacttgcacgatacccttggacaaagcttttcaatgattacactcaaaacggaattagctaaaaaattactcgtcaaagcaccggagaaagtggcaccagaattggacgaaatcgaacaaaccagtcgccaaaatttacagttagttcgcgaaatcgtcaataatttgcatgaacaatcgctcacagaagtcctattggcccaaactcgtaatctagcagtggttggtgtctggacgacgaccactggtgagacacaggcaaccaagtggccgacaacggtccaaagttgttttgcggcggtgttagttgaagccatgaccaatgtgatgcgccacgcacacgcgcacgaggtgcggattgattttgtcgagacggcaaaaatttatcagattaagctgaaagatgacggtaaaggtggaaccttgattcgtcagggcgccaacgggatttccgggatgcgaacccgtttgcaagctaaacagggcacctttgccatcacgagtagtcggcgcggcacccagttgatcttaactttaccaaaggagtagtgagtcagcatgataactttatacttagcagaagaccaaagcatgttgaattctgccttgacccaattactggaattagaagatgatctacacgtggtgggtagcgcagtagacggcataaacgcctggcaggagttgcaagaactgcaaccggatgtcgcaattctggatatcgaaatgccagggataaccggcttggatgttgctgatcgattggccagttcgcagctagccacgaaagtaattgttttgacgacttttgcgcaacgccgttattttgaacgagcagttaaagccaatgtcgcgggatatttgttaaaagatagtccgagtgatgacctaattgatgcaattcgagctgtgatgaccggccgcaccatctatgcgcccgagctagtcacgaatatgttgtcagcagacaacaatccattgaccgaacgggaactagcagttttggtcgaagctgagaaggggttgcccacgaagacgattgcggccaatttatacttgtcagcggggacgacccgtaattacttatccgccatttttagcaaattgggggttcacaatcgattagaagcgattcgtgtggcgaaagctaatcagtggttgtaaaactaggctgtttgaacgaggggccaactaggtttatttttatcaacacatatacaaatgatttggtgcgcgatataattaattgaatagtggttaatgttgagcccacttactaattacgtggcaaatctggaagaatggaagatccggtaagatgaaagtaatgatcatcggtagtacccacgctggtacggcagcggcacgcgaaattttaacacgtcatccggagacggcggtgacgatttacgagcggaatgataacgtttcgtttgtttcgagtgggatttatttgtacttaacgggtgtcatccaacacctggaagacatgttttacacctcgccggctgacttgaagcagttaggcgctcaagttaagacccgtcataatgttttacgaattgatacgggccataaaacggtgcaggtcgccaatatgcagactggcgaagtctttgatgacacttatgataagctgattatggcaactggttcatcagttattgtgccaccaattatgggtatcgatcatgagaaagtattactgtgcaaaaactacgagcaggcggaacaactttatcaatctctacaagccaaccaacgcgttgcaattgttggggccggatatatggggaccgagttagcggaaagctatgctagtatggaccaacaagtcatgttatttcattcgcattcacatattttgaataattatcttggtccccaaatggcggatgctgcaactaaactcttacaacatcaccaggtcgatatccacctcaatgaacgggtgactggattcgcaagcggttcgaatgatcagttgatcgttgaaaccgcgcagggtgattatgaggttgatctggccgtcgtttgcgcgggatttatgccgaatacggaattgttacgcgggcaggtcgctatggaccgccatggtgctatcttgatcaatgattatgttcaaacctctgacccggatatttatgcggctggggatgcttgcgtggtcaattataatcccacgggacagccggcgtatacaccattggcaactaacgcactgcgccaaggtgcgttggcggggatcaatgttttcggagatttacagccgtacatgggaacgcaagccacctcagccatgcaattatttgatcacacgatggccacaactgggttgacctatccagccgcgcaaagacgagaactaccagtacgacacgccgtctatcaaggcaattggcggccagcttatatgccaacgacggccaaagtcacgattgaactagtttataattatcagaatcgtcagcttctcggcgcgcaattctggagtcgtcacgacattgcccaagctgcaaacacgatctcagtaatgattcaaaatcagaatacgattgatgatttggcttacgtggatatgttctttcagccgaattttaatcaaccgtttaactatttaaatttggtggggcaactagccgtcaaacaagaatatcagcgaggcaatcaaacaccccgaattacagctcgtggtaactggtcgaatagtagtgataagcattgacctaacgtaaagcagcacaggcgcattaaatcacagacttggggtcatttcccaagtctgtttttatgccatccaaatgatgaaagcactgttcgtcatcccataattgttgaaaaagcttgacttacgctgacaggaaccctgtataataggttccaatcaaaggtggggatcaggacatgcaagtaaaagtgaaatggctgtcggggttgctagtggttttgttagtactggggctcagtggatgtatggcacaacaacgccgcatgaagtatgtacagtcaaatacgcctacgttatttttccacggtggcggtaataggtatcacgccgaggcacagatgggacaagcggctgaaaatgcaggggtgacaactagtgttattcgggcgatggggcttaaaaaagggcgcttcaagaattcgtagtggattcttgaagcgcccttttaaggctttaatgcgttgtttgacagtcaatgtggcgattggtcaattggctgaggctggagccgataccgtattaagcttcagtgccgacgttgatgatgagcttaccagcactgtgactgttttcgctataccggtgggcggcttggagaccagccgtactaaacggaaagacttggtcgatgatgacttgtaagtgtccttcaacggcgagctgccccaagatggctaactcccggccgttgggttgcaaccaccagctggagacagtggggccttgggatttttgagccgccgttggttgcccgtcaattgtcacgagtcggccagttggctttaagattgccaagccctcatcaatggcgtcaatggtatcaaagacggcatcgtagtctgtaaggacatcttgaatagccgtcgtgtggtaatcaatgacgtggtcagcgccgatttgcttcaacagcgtatggtgattggcgcttgcagtagtcgcaacctcggcaccgaggtacttagcaatctggatggcatttaaaccaactccgccggcaccggcttgaattaagactttctcgtcagcttgaatctttaattggtcatgtatgacttggtaagcagttagccccgctaacggcaaggcagcggcttgttcaaaggacagactagctggttttagtgctaacttgtcttctttgactgcggcatattcagcgtaggtcccgcgccggccatccgcataaatgtctgggcgggcaaagacttcatcaccaaccttaaagttggtcacggccgcgccagcctcaacaatggtcccagcgacgtcccaaccaaggacaactggcatttgccagtcaaacatgctcttaagcaacccttgacgagctttccaatcgatggggttgatactcgttgcctgaacagcgactaagacctcgtcctgatcaatgctgggacgttcgatagtggccatctggagttcttccggcccaccgtactgattaataatgactgctttcattttaaataattcctccctgaaactgaataacctagcttagcattttagttgtgctcaattcaattatttagttcgaactagcgtgaaatagatgtgcgtcgtcttcagcagccatcaattgggaagtgtgttgtggtgattggtgaaagctgagtcgatagtgtcagtcagtaggtatttgttgctgcaggtctgtcgccagttgcgttaaaaaggttttggcggcttccgacaagcgttggcccttagtccagactaggctagtgcgggcagttattcgaggtgttagtgggatgaaaatcaaatcggattggttcgtattgatgatgccatcaatccccagcgcgtacccgacgcccgcagaaactaataacgaggcattatagagtaaattataagtggcgacgatggtgaatttgggcgtgctttcaccataccaatcctgaagttgattgatcgtgccgtgttgtgcagaaacaatgatcttttggccttcaagatcagctaagctaatgtgatcatggtcagctagcggcgaatgccgcggaaccagtaatccccagcgactttctccaggcagatggataaagtttaagtcgtgtttgtcagttggttccgtgacgattccaaagtcaaagttcccggttttgaggttggttcgaatctgattcgcgttactactcgtcacgttgatcctgattttcggatactgttgttgtagtttcttaattgactgagcaatcgtcaaaaaactgcgcatctcggcactccctaattcaatcgtgccactgatttctttggctgtattaatgttggcaagcgtcttatcggctaaggcgatgatttggttcgcctgcgtggcaaagtattcgccactactcgtgagactgatatgacggccattgcgttcaaatagggtcacgcccagttcatcctctaaatcctttaattgtcgtgaaattgttggctgcgagacgtgtaagcgttcagcagcccggctgatatttaactcggcgaccactgcttgaaaataacgtagaactcgtaattccatctaaaacacttctttctattacaattaagtataattccagataccatataagcattcgacatggtcactgtcaagctttaagatgaagcttgaggttagtgcagaatagttggttttcagagaacaacgtgtaaagcatcaaggtagtgcaccatttaaccgaaatgctctgaattaagcaccactattttgccggaatggaggaatgttaacgatgaacaaaagtaatcagcccgtagtgtcaaccactgcaaccacgatacagtggtccagagcacagttagccgcttttagcacggcggatgatttccaagtctccccattttacagtgatgggcagacatacgggacgccgacctggatttggtcggtcgtggtagggcagcaactatttatccgtgcttggaacggtccgcgctcacgctggtatcgatcggccgtaacccaaagggctggtcggattcacttggccgagagcaattatctggtgaattttgtgcccatttgtgatgagcagttaaataaccagattgaccaagcttatcgacaaaaatatgccggtagtccgtatttaatgccgatgctagcaagtggaccgcggcaggcgacggtccaagtgatgccacgaatatctaagaaaggtgaatagaaatgactaaaataatgattattggtgctaatggtgggattgccaggaagctgacgcaacggttattagcagaaactgacgatgaactggtattgttcctacgtcgagcggaacgtttagcccagtatcgggagcaaccacgggtcacgctgattgatggcaacgtgcttgatacggatgaacttgccacagcaatggcaccggtggacatagtctattccaatgttggtgggactgatctagcagcccagacgaagagcattttggccgcaatggtccgaactcagcggcaacggttgatcttcattagtgcactcggcgcccatcatgaggtgccaggaaaatttggcgcgtggaacgaacaagccattgccgatttcctacccggttttcgagaagcagtgaggttgcttagtgcttccaaactggtttatacggagatccgaccagcctggctaacggatgttgccgaaattgattatgaattgacgactggcgcagaaccttttaaaggaactgaggtatcacgagcaagtgttgccgatttagtctttaaattaatggcgcatcctgaaaattatcagcgtgtcagtttaggggtcgataaacctggtacggcgggtgaccggcctagttggttgtaattcctgtcatgagccttgattgaatgctaaaataggcgttaacgctcagacgacaacgccttccgatgcggggtggcgcaaattcaaatgacgaactaacagtgaatagatgattaaatagaattcagggggaagttattgaaaagaatacgcttatgggggctgatggcaggcctgctgttattattagttggttgtggtcgtgcagagacgaccggggtgactaaaccggttacgactcaggggcatcgctacattccgacactgtttttccatgggtggggcagtagttaccatgctgagacgcacatggcagatgctatcgttaaagccggcaaaacacaaactattgtacgcgcgatggttgctaaaaacgggacggtggctttgaaaggccactttagatcaggtgattatcgaccaattgtcgaagtgaactttgctaataaccggtcttcagattatccaaccgtgggccgctgggcaaaaaatgtggtggtggcgctccaacgaacttatggcatcacgtcgtttaacatggttggtcattccatgggtaatatggcgattacctattatctattggcgaatgcgcaaaatgagcggttgccgcagctcaggcgacaagtcgcaattgctggacatttcaatggtattttaggcatggacgacagccctaaccagatgacgttgaatgctgcgggacgaccgaataaattgcgaccggcctaccgccagttattaggattgcggcgggtttatccacgtcagcaagtacgagtccttaatatttatggcgataagggcgatgtgacgcattcggatgggtccgtcagtaacgcttcatcacgctctttacggtacttagttgcggcgcgtgcgcgttcttatcgcgagattaagattactgggaaacatgcgcaacacagccagttacatgaaaatgcgcaggtcgaccggttactgattgattttttatggcccacacattaaagtggggcagtctgatggacaggcactggcgagttcgcatttttaaaattgacgctaaagaaactggggtagtcagctgacgtttgtcagtgattagcctagttttttggttgctaccaacttgtaatgacggggtattcgcgcttaaatagataaagactgattactggtaacggtgttggtcgtttgctagcgcgatcagagtggctgattatagtaggctattgatagtagtcgcgcgtccaatcgattgtatgactaatgagggtcgaacaaaccaggtcattatggtgaccaagcaacggattattggagtggggggtagtggcggatgtttagttatgagcagctcgaaaaatataatgaaactgatgtggaaatttacaggtacgttattaataatatggatagggtcggctacatgagcattcgtgagttagctcacgagttgcacgtgtcgacctcgacgattttgcgtttttgtcttaaaaatgggttcgaaggttatcgtgattttaaacgggctcttaaaagtgaacaacaacagttgtccacctacgagcccaagagcgacgtcagtgagctagcacacttttttgcaaaaactaattctagcgcgtatgaacgtaagttgatgccagcgctcacgtatttgcgtcgagccacgctggttatttttgtcggcattggttcctcaggaagtttggcccgctatgccgcgcgctgttttaccaacgctggtaaggttgcgtttggacttgaggatagtaattatccagtgaatacttttgagattcacgatacggtcgtttttgcgttatctgagagtggcgaaaccccagaactaattgcacttgttcagcattttcaacaacgccggtgcgcagtcttaagcattactaaccagtcccaatccacgctagcgaagctttccgattggaatttttcatatcaattggctcaccagagaattaatggtaattataatataacgacccaggtccccgtggtctatgtgattgagaccttagcgaaacgactataactaaagaaacgaatcgtgacttgaatagtaacgattcgttttttaagcttggaagtgaaaggggtgcttaatgatggatgaacgacagcggagtttgagcggtcagacctatgatgcacacgcaccagtatttttagagctaaaacggcgtacacggcaacttttaagccagtataaccagctcgcctatgaccaaaaaagtgagaaacgtacgatattgcaggctatgtttgccaagattggatcgaatgtttcggtggggagcccatttatttgtgactacgggtgtaatatttcgattggtcagaatgtttcaatcaatatgaactgtaccttgatcgactgtaatcggattaccattggcaataatgtcttgattgcctcaaatgttcaaatttatacggctacccatccggtcgaactgcatgaacgtttacgtgcggactggcagccagatagtgatcagtatttttgccagacgttagcgcggccagtcacaatcgaggatggctgttggattggcggtggcgtgattattattcccggcgtgacaattggtcggggatccgtgattggtgccggtagtgtggtcgtcaaagacattccagctaattcgttggcggtaggcaatccttgtcgtgtgattcggcagattaatcaaggtgaaccgcatgcttaagatgatcgcctttgactttgacggcacgctcgcgccgacgattccaatggtgattgacgtctttcgtcgtagcgttgcaccgtacgttgagcacgaactgaccaagcaagctatcgtccagacgtttgggctaaatgaggttgggatggtcaaagcagtggctggtcaacggtggccggtcgctttggccgccttttatcaagaatacgctcgcgcacatttacgggtgtcagcaccgtatccgggaatcgtcacacttttagaactgttgcagcagcaagggatggcgctagctctgattacgggtaaggcggctaagagttgtcaaatttccttggacgtgactggcctgacgtcctatttccccacgcggttgtatggttctgagtgtcgacctaataaagctgacaatctgcgacaattgatgcgcactaagtcgttagacgccgcggaactcttgtacgttggcgatactcgctcagattttgaagcagctgatacggccggggtgcaatgtttgacggcggcgtgggatcctaatcagccaattgttgaagccagcgatcagatcgtgtttacttcgctcgagcagttgtgggtctacttgcaacggcgacttggtcatggattggtgcggccaatgagccacaaaccacggtgaaaaaacaagctttttagtgtcaacagataaagttatgacacggcgtatgctaaatgagggtcggtattgagtgatatggtgagaaattgcttgccgggtcttgcccaatccgccataccgcagtatggttaggacaaacgagttaacgggagtgacaatatggactgggaagactattttccaacggcaatcgctgaacgtgggtacgattattacttacaggggtatgtcactgatttaaaacggaccaaaacacaaattacggcaatggttacgggcacgcaggactatggcgtggtgattgatctcgctaatggtgactttcacggtggcgcgtgtgagtgtccgtatgccaatagtcatccgtactgcaagcacatggcggccgttttgtgccaagcgacggcggctgataaacctgccagtcaacagcaagtttccaaagcaccaactagtttcgacagtcttgaacagactgccactaagctggtggagcgggctactgatcggcaagtccgggactttttgagtgtggtgttggcccatgacaagcatctcgtccagctgttccggacggtcatgggtgagactaatgttgtgacagatttacctgaatatctcgcgagtgttgatgatttatttgacacaaacgcggatggcggtggttttatcgattatgacgcggcgacggacttcggtgatgaggccttaactctcctaaaagaagaggtgcaaccgttggtcgatcacggcgagtatggtttggtatttcaaatcttagcgcatctgatgcttaaaatcgaccacgtcgacattgatgattccgatggtgagatcatgatgatcatgagtgctagtgacgacttgtgggaagctgtcttaacaaaagccgacgcggatgtgcagcagcaggtgtttgattggttatgcaaacaattaacgaagtcgttgaatatcattgaagatacgcttgacgatttattattcacatatttcaagacgccagcgtttattgatgcaaagctggtgtataccgctaagcggttccgtgcggtgcaaaaacacccggatctctgggactatgactggcagataaaaaaatggctaaagcactatttacaaatgatgtctgcggctcatgtgcctgataagcaaattattaaattttgtggcgctaacttggcgataccgcaagttcgcttgttttatagccagttctgtcttcaacatcaagatgaggcgcacgcggtccaattgctaaaggatggtaaaaagttggtcacggacgatcccagcatgttagcggaacttagtcgccaactaaaggacgcttatcagcaattaggtgaacaacaactgtatcgtcaggaattatggcaattgctgactgaatatgcgccagcggatgagatgctattttcagagttgaagcagagttacccgaccacggattggccggcggttcgcgagcaactgttgacagcgatcgcgaagaattccaatgtcgatttgaaaccactgtacgtgcaagaaaacttattgaacccgctattaaaagcggtcgtggccgcggacggactctgggatttacggatctatgagccgttattgaaaccacgtttttcagatctgctattagcgaaatatgatcatgaagtgcggaaaatggctactactactggaactcggcgaaagtatcaacaattggttggcatattgaaacggatgcttgcttacccggctggtaaatcgaccgtgcaggcgattgtacatgattggcagcaacaatatccgcggcgttcagcaatgatggatgagctctcgcggttaaactggtaattgatcgttagttggcgcagcaatcgcgaacagagttgagtcgcatcgttaagtttaggatcggttcctaccccaaacttagcggtgcttttttcatagccaactgcgggcataataaattgtctttggggcctcggtcatcctggccaagctaaaatggtaggacgttagtctatttcaaagttattaatagctgtccgtactcatggctgaccggtggctgtcattgaccctgttattcaaaataaggctaatcagtcatcgaatcacaattaaatttgaataatgaccgaattatcatcttggaaccggtataatgggccttaagcgaccgaactgattaaccatagggtgtggatatgcgctgttggcgtcatttgtggttcggccgttgctacgaataaattagcgagtgatgtgaggacgtgatcagtaatgaatattttgattattggaacgggtaaattggggtatgaagtgtatcgtcgagtggccgtgatgccgcagcaccacgtgactttgttggatcatcaccgacatgagcatgatgtctcgttagccacgcagttaatcggggatgcgagcaatgttgatgatttaaaacgcgcgctgcgagggattgacgtcgtattctcaacggtgggcattacccacgcggcgcagtttgccacggcattggtgcaagcgatggatgcagttggggtcaaacggctattttggacgacccagtttcaaatcaactatgatcagatttcagaagcaatgtacaccttagcccaccgcgagtttgggtttagtcgtgaagttgagacgacctatgtggcggggcaaaaggccggggccgcagtcatcaggaatagtgatttggactatacattgctagcctgtcattttttcaagtacaatgatgaagcggatcaattaattgttgaaccagctggaaatgctgttagcggtgggccacttagtctattctcattggcgacattgatcaccgatatgttggaacatccacaagattatccgcaacgtgagctcatgatctcagcttggccaggcgaaaagtaacatcagttctggctaatcaactttaattgacaacagtagtactcataaaatataagttttgatggcgatagctaagttgcaccaacgggtaactgggctatcgccatttttgtgctaagtttcaaaacttacgactgttaccagtgtactaatgtaaattggttctatttttctgagccagacggtacaatatttgtaaattcatcaaaagattgaggagatgggagcaatgtcacaatggcaacaagattgggcttaccaaaagtactgggtcatggcacactcacagcagcattataatgccatccgacaattagctcggcacaatgattggtcagctgcaaaacaggaacgctaccaacaattattagcagaagccgaacaaattacgccaactaaagccacgttgacaacggcttatcagcacgtctggggctattttaaaaagcagtgtacgctggccgagaagcaacgttacttgaatttactaacgaatttaaccccggcacacgatcagcttgggccgttcttgtggcagttgacggtgaagtacgaagtggcttatttgctggcgtcacgcttgctgcgcgcgtttgatcagcatgaaaatcaacggtgattcgtataacatttatattatttaaacaataataaatatgaaaaaacaatgaattttttacgattacttcgttcaggtctttacaaagttatgaataacctgctacaataataaacaagttataattatcataataaaaacactaatcaaggaggcgaaataattatgattaaattgtttacgcaagcaggatgtaactcatcgcgaaaggcccgccaatggttccgggatcataatattgcatttgaggagaagaactttagtagcgcagcccctactgttagtgagttaaaacaaattctgtgcctaactgagaatggattggaagatattatttctacccgttcacaaagttatcccgcaattgctgataagctgccagatatgtcattcaatgagacgctccggctgttatgcgaacaaccccagttgttgcggcggccaattattgttggtcgtaataaattgcaagtaggctttaatgatgatgatattcgccaattcattccccggcatattcggcgactgaattttcaacaaaccttagttggattggtggatatgtaatgataggggacttaaagtccaccatattgtgaaaatggtaattactaggttgatgtaaattaatgttaatccgacgctctttttcataattgttgatgccaatagcggcctaacttgattgaaagacgtcataaagaaacaaaaacatcccggctagcagacaggctagtcgggatgtttttggcgcttcagcagtcatttagtcgactgtgatggtagtggaagatgccattagctgtgccaactgttcttcggttgtccgtttttgggacaacggtggcaagttgtcgagcgtaaagtaggctgtttgggcgacctcaatgttaggctcaaattggccatcagtaatttcacaagcaaagaccaatttataatactgaaatggttggggaatatcgacacgtagagcagtatcaaaaacggtgatgagcccctgaaccgcgacgtgacggccagtctcttcccacacctcgcgttgcacattttcagtcggcgtgtagcccacgtcagcaaagccgcctggtaaggcccatagtttcgttttaatatcttgaacgagtagtagctgattaccatggcgtatcaagccgcgaacgtcgattttgggggtaatgtagccagagtcctgagttagagcagccgtcaggtcagcagtggcgacgttggcagcggcggccatttgttgaatcaataaggtttgtaacttttgatagcgatctttgtcgaaggggtcagtcgtgtaggctaatccgctttgaatcagggctaacattgctcgttgagtagttaatagtgaagatggcatgctaatgatcctcctctaaaggtaaataagtttatcaggtgcaattttagtagctaggttatccggtagtggctgatcagtcacaaagtaatcaaaatcactgagagctagcaagttgaagttgtggctgacgttcaccttggtgtggtcaaacaacagcactagccggtcgctttgggcgcgtaacgtttcctttaaagcgatatcagattcgtaagcgtaataaacgccgtctgcggtcaacccagcgcaactcaagaccgtggtcgtaaatcgaaatttgtgtagtgctagaatgctgtcagcgccttgaacacaccgttgttgtgcatctaatgtgccacccaggatacgcgtttgaaaattgctatgtcgtaatgcctggtcagcaatgtcaagggaattcgtaacgatcatgccggggtgcttggactggagatattgtggtagacaggcaacggtggttgagatatctagaaataataacgcatcatttagtaaatacgaactggcagtgtgggccagggctcgtttagtttgcagtaagtcatcatcccggtccaggtactgatctagcttattaaacgtattcggccgactaatgccgccgtagtttcgttcagccaaattatgagctgcgagtttgacaatatcgcgccgggcagtgtcgcgtgaagtccccgttaattgcataatgtcttttaaactcagtgatgggtgggtttttaattcatcaagaatcaatgctaagcgtgttttttggttcataattgatcaccttaagcttttttaagtgttaaacacatactaacttattttagcttaaatagaaagccaatgacgtcaattaatgaaaacggttgaattaatcggcgttgatgttgtggttacgccttgaaacccttaaaattaagctaattagtggcagggctacagcatacctacgaaaggatggttcagatgaaagtgaaaaaagtggtcattgttggtggcgttggtggtggtgcttcagcggcggcccgcgtgcgtcgattggacgagttcgcccagattacaatttttgaaaaggggccggatgtctcattttccaattgtgccttaccgtacacattcagtgatgtgattgaccagcccgatgacgtgattttaaagacaccgatgcaattcgagcaacagtacaatattgacgttcaagtgaatacaacggttgtcgccattgatgcgcaggctaagacagtgatgatcaaacggcaaggacaggtagcaacgacgatcgtcccatatgatacactgattctttcacctggtgctcgaccgatactacccgcagtgattgcgggaatcgaccggcccaatgttaaaacggtccgcaatgttcaagatgtccgaacgattcaagcgtatctgactgaacaacacgttcatgatgtgacgattgttggcggcggctttatcggactagagatggctgaaaatttacaacaggctggctatcagatcacaatcattgaggctgccgagcacgtcttgggcactttggatgacgagtttgctcagctagtacacaaggaactatacgatcacggtgtgcaggtgatactgcaagaacaagtgacggccattggtgcaacacaagtgcagctcgcctcgggacgcgccgtgaccagccagttagtgattgtggcaattggggttacaccagtaactgaattagcggttcaagcgggttgtgcgttaggcgtgaccggtggtatcaaggttgatcatcgttaccagacgtccgtggccgacatttatgcggtgggtgatgccattgaagtgactaatcggcttacacgtcaatctacgcggctagcattggcatttcccgcacaaatgcaggcccgacacatggtggatcatttatacgggcggacgccacagtatcagggtgtgatcggatcgcaggttcttcacgtctttgcgttaaacgtggcgtcaacgggcctgaacgctactgagtgtgagcaccagcaacttgattatcggttcgcaacggtggcaccacagaatcgggtcagcgtgatgccagggacaacagccgtctttcttaagttgatattcagttatccgaccggtgagattttgggcgcgcaggccattggtcaatcggacgttgacaaaccgattgatattatcgctagtctaatcacgatgcacggtcgagtcagtgacctgacagatgttgaattatgttattcgccatgggtcagtaccgccaaaaatgtcgtcaacatggttggcttggtggcggaaaacgtcctgaatgatgaatttaagcaggttgcggtgacacaggttcgacagctggtcttggcgggggcgtttatcatcgatgcccgtgaaccacaagagtacgctgatgggcacatcaagggcgcgcataatattccactgagtcagtttcgacagcgcttagtggaaattccaaccaatcagccagtttatattcattgtcagaccggacagcgaagttacaatatggtccgcgcgttacttcagcgcggctatacgaatgtggtcaacattgctgggtcgtatgccgaactagttcagtatgaatattttaatgatcagacaacagggcgaacctcaattctgacacgaacatgatgattgataactaagatattaatttcaacaaaatttgataacgtagcagaggctattggataaaatagaaggttcagaagtgttagactgaaattatcataagaaagttggtggcaaaatatgcgaacgattgaagacgatgcagcgcttaagattctagcggatgtgattaagattccatcagttaacgaccatgagttgacggtcgcaaaatatttgcaagccctgttggcgaagtatgatatttcagctaaaattcaccccattaccggtgatcgtgcaaatctagttgctgagattggtcatgggcagcctgttttagcggtttccggtcatatggatgtggttgcggcaggtgacctggcggcgtgggacaccgatcctttcaccttagtagaaaaatccggtcaattatttggtcggggtgtcacggatatgaaggctggtttagtcgcattagtcgttgcgatgatcaatattcagcagcaaggtggccctaaacatggcaccattcgcttgttggcgacaatgggcgaagaagttggtgaagctggctcggctgccttttatcaacaaggggcgatgcaagatgcagctggtttactgattgctgaaccttcaacggtttatggaacagcggctgagcagaaggggtcttgtgacttaaaattgacgtctaagggtaaggcggtacacagttcgacacccggacgcggctataatgccttagtcccgctgattaaattactcaatgaagccaatgactattttgaaacgattccggcaggcgagatgggaccggtcagatttaacattgacgtgttaaacggtggggaccaagtaaattcgttacccgatttagcgactgcactcgttaatgtgcggacgattccggaatacgataatgaccaagtgacccaaaaattagcggacctgatcgcggcgtataatcagcaaggtgctgacattaaaatgaccgctatcatgaatgagtcaccaattgcaaccacggctgataatcggttagtaaagttagtgcagaccattggcaagccctatgctggccgcgatgttgtcgttgcctcaagtccgggaattaccgatgcttctaatttggctaagcgtcaaccagccgattttccctttgcggtttatggaccgggtaatatgacccaacatcaggtcaatgaaagtttaccaaaacagatgttttatgactttattgcaatttatcaacagctgtttacacgttttttggccgagtaatcggtgttgattgatcgtaaaatcaaagacccgctagcagtcagtgactgtcagcgggtctttgaatggttagtaccaattttcaggtgcatgggtcggtgttgaaaaagcaacggcaatttgtcgcagggcttcgtaagtttcggcggtatttacccctaaaattgtcgccattcgttgttcactggtttcaaagaaacgttcgatcttggtggctaattggcgggccttgggtgttaggagtagtcgtttgtagcgaccatcgtcctttgctggcacgcgaatgagtaaatcagcggcttccattttggaaacgaggctggaacaggttgctttacgaatattgaactctaattctaagtcccgttggaagaggtcgtgatgctgttcattgttggcaataaagttgatcgtactgatttgcatgccagttagtcccagtgattttgcataatggtctgagtccctggctaatgcattgttcgctttcttaatcatgattcctaatgaatcttgcatgggaggactccttaatgatattatggttcgtattctaactaaagtgaattataagaactaattgttaaaaagtcaattaaaatagggcttaaaattttgaaatagtgtgctaaaatagttaattagttcgtattcgaactataggttaaggagctgattttaagtatggaaaaacgtgttgacctcaaattgattcttgcaatcgtggctgccggattactttcattttgcggagtgatcgtggagactgcgatgaatatcactttccctaagttgatgcgagaatttgcactcaatacggcgacggtccagtggatgaccacggcttacttgttagtagtcgcaattattgtgccaatttcggcgtttctgaaacgccgttttcgcactaaaacgctgtttgtgacagccaatttattgtttatactgggattggtcgttgacgcgaccgcgaccagttttcccgttttagtcactggacgaatcattcaaggactgggaactgggattgctttaccgttgatgtttaatattattattgattgggcaccggcacggcagaaagggaccttgatgggaattggcacgctgattaccgcaatcgccccagcactggggccgacttttgggggcttgatcgttagttggatggattggcattggattttcgtgctgctgatcccggtactcgtgatttcacttgtgttagggctatatgcgattcggcaagcccagccgacagttaaagttggatttgatgtggtcggttggctgatgatcgtcctcttattcgttggctttacaattggatttagcaaattagccacgattaccacgcaaccactgatttttgtggcttggctagtagtcggtctgattggtcttgtggggttcgttatccgcacacgtcgagcggcacaaccgctaatcaatctggcgatttttaccacaaaatcttatgatttgcacttaatggcgtactttttggttcaaatctgtgccctagggttggccttcatattgcccaactacatccagttagtgaacggcaagagtgctttgttagctggcttgtttgtactacctggcgcggcgatcggggctgtttttgccccactaggtggacggattctagacagtctgggtgcagccaaaccagtcctaacgggttcaacaattttggttattgccatggcactgtttacggtgttggggatgcacctgtcaggcggtttgattttagccatttacattttattaatgattggtattggcttaaccatgggtaatacgatgacgagtggcttacagcagttgtcagctgagcatcaagctgatggcaatgccgtgttcaataccatgcagcagtttgcaggggccattgggacttcggtcgtgtccgccgttatcacgttagttcaagtacagacgactggaacgagtgcgcatcggacagcgttagggtcaaccatggcgttggggttattgctgattttagtgctgattgaattggggaccatgatattggcaatgaagacgcgtcaagctggtcaacgataaaaatgttataaaaagattgacattgttttgagaaggtgtaatctttagttgttcaaaagttaatcggcgatgacgttcgccacataataattgataatcaatttgatgacgtctactgtttgtttttcagacagtagacgtcttttctttttggttaagaaggagagattgatatggaaaaacaagttattgaaacggtaaaggctcgcgaaatttttgattcacggggtaatccaacagttgaggctgacgttattttgtcagatgggacgctaggacgcgcggaagtaccatcgggagcttcgactggagaaaaagaggcagttgaattacgcgatggtggtgatcgtttagccggcaaaggtgttcttaaggctgttaataatgttaatacggtcattaatcatgctttacatggtgctgacccgtttaaccaagcccatattgatcaaatcatgattgacctagatggtacgcctaacaaagcgcgtctgggtgcgaatgctattttgggtgtttcaatggcaacggcacgagcggcggcaaacgcattacagcagccgctttatcgttacttaggtggcactgatttagagctaccccaaacatttcataacgtgatcaatggtggggagcatgcggataatggcattgatattcaagaattcatgattacaccggtcgaacgaaccagttttcgggatggttttgaaaagatcgtgaatacttatcatactttgaaaaaagttatcgaagatgccgggtacacgactggtttaggtgatgaaggtggctttgcgcctgatcttaaaaactcagaagaagccttgcaaatgttacatgatgcgattattaaagctggttatacacctggtaaagaaattgcgattgcttttgacgcggcggcctcgtatttttataatcgaacgacccacaattatgactttgagggcaaaacgtacacgccggcagcccttggtgattattatctgcagttattagcgaagtttccagaaatcgtttcaattgaggacccatacggggaagaggactgggataactttgcaagctttacagctgctcatggtgaccagcttcaaattgtggctgatgatccggtctgcactaatccgcaattaattcggcaagcaattcagcgggggatggctaacaatattttaattaaattaaatcaaatcgggaccgttaccgaaactttggccgcgattcggctagctcgcaaaaatggttatgccacgatgatgtcacaccgatctggcgaaactggtgatactttcgtcgctgatttcacagtggccaccaatgcggctcaactaaaagctggtgcgccagcccgctctgaacgcgttgaaaaatataaccaattattgcgaattgaggaagaattaggtactgacggtgctcggttggcccacttcccaaataacgtgatgtttgactaattattcgtgataaacctgattcgacagttaggttgccagtggtgcttgtcaaattcgaggtgcagacatgattgaagatttaacggagcaacaagcagccgctaaactagcggcagatggatttaatgatgtctcagaaccaacgtttaacttttttaaggccgtagtcagtcgtctatgggaaccatcggcatggattttggagggagccttagttattgaagttgttttgggtaaagaaattcaggctggctttattgcgttaatgctggtctttgcagccgtcaatggtgcaattcaatcgcgacgtgcggccttggttttacaggagctagcgcatcaattgacgccaaccagttcggtacgccgtgctggtcattggcagttgattgatgcgaaggctttagttgtgggtgatctgattagtttacaggtagggagtgtaatcccggctgatattcgtgtgttgacgaatccaattcatacggatgaaagctcaataaccggtgaatccgttgcagttatccatacgtcgggtgaaacggcctttgcaggcacaatggtggtagccggggaaactttagcacgcgtactggcgactggaagtcatagtcgggctggaaaaacagtcagtttgattaatcaaaacaatgcgcctggtcatttacaacgattattgggtaaaattattggttatttggcattgttagatagtgctctagcactcatcattgttgggatagcgttaattcgccatgcagatatgattcagatgttaccgtttctagcgatgctgttcattgcgacgattccgattgccatgccgtcaagttttgcagttgcaaattcggtagaagcccgtgaacttagccggcagcggattctggtcagtgaattaacgggtattcaggaagctgccaatttgaatttattacttgttgacaaaacgggaacgataacgacaaatcagccgcaagtcgtgcagtttaaaaatttgtcggccagatcagatcagcaattgttgcggttagcagctagcgcgaccgattcgcgacatcctagcgtggtggatcaagcaattgtgaactttgctcatcgctatcagttgaaacggctgccacagcaggaatttaagccatttgatgcaagtgttggttatgccgaagcgctagttggtgaagcgccaacagttgtgcgggtacgtattggtgcacttagtcgtttgtacgagttaaccgcacagcaaccggctttagcaatcgaccaactggatttgacccggggccgttcagtggcggtcatgattaataatgttttacaaggtgtgttgattttgcaagatcaaccgcgcccagatagtgcggcggccttaaaaaggattcaacaccggggcgttaaaacgattatgctgacaggcgataatttaaaaacagcgcaggctgtggctgatgcggttggattaaagggccaagtagtttcctaccagacctttaaaacgcactcgcgaccgttagcgcaagttgccgggattgccgaagttgttccagagaacaaattggcaattgtcaaagctatgcagcgcgcgggttacgtggtggggatgacgggcgatggtgttaatgatgcgccagcattaaagcagtcggaggttgggattgccgttgacaatgccactgatttagccaaacgaagtgctaagttcgtcctgttaacgggtggtttggcaaatattctgacgattttagacagtggtcatcgcgtctaccagcggatgctgacttggacaattaccaaactcactcggacggtcgaactgaccgtgcttttaacaatcggctatttatggctagattacgtgccattgtcgctgaatgcgatggtattagtggctattctgaatgatttagtaacattggtccttggcactgatcgcacaaccattcgccatcgtcccgaacagtgggatatgccccgcttaagcaaaattgcggggttcctagcgactggttggacagctgtgggtgttggtttgatagtctggctgcatggtttggggttgtctgctggtcagttgagcactagtctttacgtctatctcatatttagtgcaatgttaacaatcttgatgactcgtactagtggtccattttggcggggacggcctagtcgcgcagttggggtgaccatcggcttgaactgtttgttgaccatcggattagctagcagtgattggggagtgccggctattagtggctggctaactttaatagtgatcgtattagtgttaatgactggtatcggtttgacggtggccggcgacctctggcgacgattgactaaatgattacaatgctgatattaacggtgatattccgcaggggattaattaattgcgaaaagcgtgaatctcagctatcgttaaattggcattaaaaacgaacggaggtagcaaagttgcaagcatacgtcgtgaaccaaccaggtggaccagaagcgttacaattaacgacacttcctaaaccgaacgtcaaaccggggtggacccgggtaaaagttttaggttttggtatcaatcactcagaaatctttacgcgggaaggcaagtcaccgagcgtgcagttcccacgagtgctcggaatcgaagtagttggtgtggtcgatgagaccagtgcgccagcaacattcacgtctgggcaacgtgtggtttcaatcatgggtgagatgggtcgggcatatgatggtagttatgccgaatacgtattattaccgaacgagcaggtttatccgatcaaaacgaatctatcgattgcctcattggtggcaacccctgagacctactacacggcctatggcatttttaagtctttgcagcttaaagcgacggaccgggtgctaattcgagcagctactagtggggttgggattgctgatttaaatctgatcaaggcttataatccgaagatccatgtggccgggactactcggcggctagttaagcgccaacaattgattgatgctggctttgatgaggtcattgtcgctccggatagcgctcgtttaccagccgcaacggctcattttgataaaattatcgacttgattggtccactcagtgtcaaagattcgttgtcgcatctcaacgaaggcggcattgtaaatatgacgggcgaattaggtgggctgtggaccgttcctgattttgacccgattagtgatattccgaatgggtgttatttaacgggcttttcctctggcgatgtttctcagacattgttgcaagatttatttgacttcatcgcagcatatcatgtgtcggtcgcccctgctcggatttttaactttaatcaggtaccggcggcccatgcttatttgcaagcggcagacagttttggaaaggccattgtgttgttggaccaaaacgctgagtaatctggtggttggctactctaagcctagtacttgcaagttggacttagaccaccggattgaaatctgtaaaggaatctataataaagaaatcacgatcgtgtctgaccgtaaatcggctaatgctgactggtctgacgcgatttttttgcctaaatggtcgcttaagtgtatggtttgcttgaaaggtaaagcagttggaatcgtatcaaaaaatacaatcattagctggtaatgttcgcgaagtgtacttgtaatcccatgggaatctattagactgggtttaaggttgaccatcggttgatctggtaaaaattcgaagaggtggtagcagtgacgatgatttctagtccgttgatggaggtcactgacgttggcgattacctcaaactaggggcctgtactgcggtgatggcccagccgattctcacagacgcattggcaagtgggccgtcgattgccacgcaaactgggattggtgttgtttataatctggtcaagtatacggcaccggcctttatttttggcattctctatacgacgacgcgtttgacgcttaatcagaccgcgttgacctataccgactatttgcgccagcaatggcatgcgctgtttattccaacgatttggtggaccgcgatctacttaatcttgatgccacaattgcagcaaggtagccagtatcatgactggcggggatttttatggcagttcgttaatggtaatgcagcgcctcatctgtggtataacaccatgatgctacaatttatcatattaatgccgttattctgggcgcttggccgttggtgtcagtctcgacctcgacgcggctggatcgtatttggcggtacaacactggtcgccgttctttggttgtggttttatgaccaacaagttttccatggtcctcacagccgtgattggtatttactggaccggctttttatcagtttccagattttcgggttctatggcatgtaagcttgggtgtttcgagatacctttcagcgcatgcttaacaagtggtggccgggattacttggtctatggttagttggcctgatctggactaattgggaactgttcagttacggcttcccggttaatttgcgcaacgccccgtattacaaaccatcaatgacggggtatgcgctagcagtcatcggcctgttggcggcgttgtgtgagattcaagttcgtcgtcaacgtccttttagcaaatttgtacatctctttgctggtatggcctataaggcatacttagcgaatgttttctggtctgaattgttgtggcgtggttttggtcgtactttgatggtcaaggctccctggctgagcattgcgctgtgttatggtttgacctggttattgtcctttacaacggcttttggtctgcatgcaggatggatgcgacttaaacgtgaatacgagcatgattaggggctaaccttgtaattagtcgtattcttcatgattaaagcgggacaattgtcgtgtcatactgggatgtaagttgaccagaccactttctgaatcggcttgaggtgtcgtgaaattgcgttactgtgttaatcataaaattattgatgctgtgcagatgttcgatgacaaaataagcacgttgtaaaaatcaccagagtgtggttttacaacgtgcttattttgatgtgggaattaggtcaacagggcttttgctgcgcgctttatgaagtagcgtttttgataagtgactacctgataatttttcaaatgaagcgcctggttgtttggttgttagttgaccacgattgtctctgtaatttgaccagcattggggtcggttagatagttaatactattggtcatgccaacttgcgcgggaccggcctttaccgtaatcgtcgtggcgacttcaccagcttttttttgatccatttgcttaaataaatcaacgtctgttttcggtaggtcgttagcagcgacaacggcactggttttcgtataggtcgtaacaatctgctgattgatacggatgattttattagcgttgatgatgagatataacataccggtactatcaccactggcaacggcggtatgtgttaattgatagccagcgtgggctgcatcggttttgaaggccgcataggtcacgttttgattcagtgagcctaatgaatagtgactgaggtcctggatagcagatcgttcataactatcataacgatgctgatataggtagccatctttgatcagcaacttgcctgtatcgctagcgctagtcgtagtttcggcagcgatccaggtaccattcaaattcgctacgttgacgtgtttaggcgccgccttggcactagtatcagtgaaagcgcggccccgttcaatggtcgttgcctgctcagtatctgaatattgaatgttgacagcgtaaaggtggtgccccttagcagcaaaggcggtgttgactggtaacggatcggtgtgattgccggattccaagtaaattaagtcagtcagtttgttaatctggattgaggcaccgagctttttcaaaaccgcgttgatctgactaactgacatgtgatgcagccggtgtcggtaacttttcatgatatggcgttgctgatcatggtgccatttggcgtacgaaacttgacgatgtttgacgccggcggacaaaaattggccgttactagtggtccagcttgattgggcagtagttttgtcaaccacggaaatgtctaaattgctggcgacgccgtgttttgtttggctggaactaacggcttgatcaaaagtccatgttttggttggtgcttgaatcactttttgggtcgtcgctttgacggaccgatgatgcttcactggagcgaatgtttgggtcgtacaaccagcaagtgcaaggccaattgtcatcaccaaaatagctaatttgtgcattagggtactcctccaaatcaataagtatcgtgatcatcagtatagcatatgcgattatggtgagtgtcaattgtactggacctggtgtgcgcagggttcatgagtgttgggaggtttcacaactgactgcttattttctgttgagtcgcgcacgctaatctattgatttcaatctgcatcagtttaaacgaaaattgtcgtggtgcttgatggctagggttatttggatggtgagtgtttcgaataacagctagtccgatttaagggttgacgatgatgaaaaagcgtgtatacttctaaaagtagttagccggctaatcaattttagaaagaaggatttcaatgcctgacttttcgtttcgtgatcgaccagataaacagcgtgtgcaattgacgctgggcaaagcgagtagctcggcggatgctgagcaggtgttggcttttctggattttcagtggacatttcgaaccatgcaagccacctatgaacaattactcgatcaatatcaactttcagaatccaagtttattattttaatgttgctggaaaatgaaactgatcacacgctattgccgtcggagttagccacaaagctaggatctgctcgggcgactgtgagcaagttactggtcggcttgcaaaagcgaggctgggtggaaaagcagcatccacaagatgataagcggacggttgccattcatttgaccgccgccggtagtagtgttttgacgcaatttttaccggccaattttaaggcggttacaacaatttttgcgtcgtttacggttcaagagcagcagcagtttaaaggcttattggataaaatcaagcaaggcacccaacaattaaaaagtgaggcaattaatcatgaatgacaagaaaattgaattgttaacaacatatttaagcttatacatcgatcatcacaccgttttagccgatatgcaaaatgcgacgggcaagtacgtcgtcttagatgttcggaatgcaccggcccaagtgaagaaagatcaaatcaagggtgcaatcgcgatgcctgccaaggatctggcaaccagaatcggtgaactggatccggcgaagacctatgtcgtgtacgattggacggggggaacaaccctaggcaagacggcgttactcgtgctactatccgcaggctttgacgcgtatgaattagcaggagcgctggaaggctggaaagggatgcaactgccagttgaagtgcttgcggattagtgaaatatcgatttagacttaagtcatagttgtagtgctagacgcttaaagtagccagcggtgatgaaagtaatcaccgctggctactttgcgtttttgtgataaacactgggttgcgtcgtccacaatgagttgatttcgtatattgtgaaataagttcgttaattagttggccttacagtttatcattataatccgagttgatttgaaaacatgtccccattaaatgccttttctttcaagcctgtgttgaactttaacgggcgtaaccagtcaacatcaccaactatattttgccgataaaataatgaaaatgggttttactttgtgtaaaaatgaactacaatataaatggttaatgtaaacgcttacagaacttaagtttgataatgattatattcaagtgcaggaacatagggaggtaatcttatgagtagtcgtgatacggcaaacgttttatggtttgatgaattacaccgcgaagatgtgaacctagtgggcggtaagtcgtcttcactgggtgaaatgacgtcatcgatggatgttccagtcccatatggctttgcgaccaccgcccgggcgtatcagtacttcatgacccagacgggattgaatgataaggtcaatgatttgttagccagcattcaggattatgaaaattctgatgaattgcatactgcgtgcgaacaaattcgtaacttgatcgtgaacgcgacaatgcccgcagatctggcggctgatattgaacaagcctatgcggatctcgctaagaaaatggggcaaactgatccgttcgtggcgattcgctcttcagcgactgcggaagacttaccaaacgcttcatttgccggccaacaagaatcttacttaaatattaaaggtgctgccgatgtcgttaatcgggttcaacaatgttactcgtcactgttcacggatcgcgcgacatattatcggcacaaacagcattttccacacgaaaaagtggccctctcagcggcgattcaaatgatggtcttttctagggcttccgggatcatgttctccgtcaatgtagcggatggggatgcttccaagatcgtgatcgatgccatttatggtttgggtgaatatattgtcttgggcaaagttacgccggatcactttgttatcgataaacaatcaatgaaaatcgttgaaaagaatattatcaaacaacctgtccaattaatgcggttaccgggtggcgggactaaggaagagtccgtccccgatgaattacagggtcagccagtattaacagatgcgcaagtcattgaattggccggctacgctaaagaaatcgaacggcattacggttgttatatggacatggaatacgctttggacacgaataccaaccggctatggatcgttcaagcgcggccagaaacagtttggtcacagcgtaataagcacaaagatgcagctgacgatgaagatgttgtggatgaggcggatgccaaagttatcgtccgggggttaccagctagtccgggcttagccagtggggtcgtgcatgtcattgataatccgaaagacattgatcagttcaagcaaggcgaagtgttagtgacgttaatgacatcaccagattgggtaccggcaatgaagaaagctgcagcgatcgtgactaataacggtggcatgacttgtcacgctgcgatcgtttctcgtgagatgcagattccatgtattgtcggcactaaaagtaaggaagtcgcggcaaccgacgtcttgaagaccggcgatgtcgtaacggtcgatgctaagaacggggttgtttatcaaggtaaagtcgctagcatgttgaagccaaagagtggtgctacggcggttgctggtcaggtggttgcggccgagagctttgctccaactgctacgggcgtgatgatgaatttgggtgatcctgatttggctgacaaatattcaagtttaccagctgatggaatcggcttaatgcgcgaagagttcctatggacaacctttattcatgaacatccactatacttgatcgagcagggtcaccctgaaaaggtggtcaatatgctggcggatggtatcgcgaaggttgttcgggcaatggcaccacggccagtcgtcctacgcttctcagactttaagtcgagcgaatatcgtaatctaaagggtggcgacaaatacgagccgcatgaaccagctgatttactgggttggcggggtgcatctcggtactatgattccaagtatatcgaggcattcaagttggaactggctgcggtcaagaaagttcggaacgaatttgggttgaagaatttaaatgtcatgattccattcgtacgaaccgttgacgaagcacaaaaagtaacgaccattatgcgcgatgaaggcctagctcggagtgctgacttcaaagtctatatgatggctgaaatcccaaccaacattattttggccgaccaattcaatcaattcgttgatggctattcgatcggttcgaatgaccttgcaatgttgattctgggttgtgatcgtaataatgatacggtggctcacctctttgatgagcggaacttggccgttaaacgagcgattcggcacctgattaagacagcccataaagatggcaagacggtttcgatttgtggtcaagcaccatcagagtacccagagtttactaacttcctgattcaaagcggcatcgactatgtttcagtcaatccggatatggtcaaggagactaaacgaaatgtggcgcactttgaacaacgcattatgttggacaaagcgactggccggggcttacaggacccaattgattataaatggtaaactatgattcctgttaaaagttaaataatcactaaaggcgaaccaattcgtaactgaattggtccgcctttaagtttgtttagatccaaatactgattcagggttaattcggagcaagaggtcatctaaaaatgacgggcaggtggcatatgatttactttttaaactgtttcaagtaccgactagcaaataatttgtgaaacttaacgcccaaagtcgggttggcagcgtcaatatccgcatacatcgcggtggtaattttggttaacaagggtgccagttgatcgagctcgtcgtcagaaagcgtgttgacaaatggggggacctcctgggctgcggatgcaatctctttgcgaccagcagccgttaagttcacaaggttgacgcggcgatctttggtggacttggataaagtgaccagctgacgattgacaagtttatagacgaactcgctcgttgattgcggcgacatgccaaggcgacttgccaactgtttttgtgagaggtggtcctcatcggctagtgctagtagaatcttgccctgaccttcaacagttattcttggacgggcctgcttgacaatgtcatcataaattttgcttaattgttcgtactcggccaattttccggcgactagttccgccttaatattcgttgtcacgattgatcattccattcgttcttttcttaagtatacaacattctttggtatgcggtacgttaaggttagttgatttttagattgatggtcaataattagtcgttgacaatttagtcagggggccttaacatatatttagtcagggcacctgattaatttgtgggaggttttaacttggatgaagaaatgatgattcaaatgacacatgttcagaagcgatttggaacgaaagtcgccgttcaagacttgtcactgcaagtccaacggggtgaaatttttggcttattgggtcctaatggtgcgggtaaaacgacggtcatcaggatgatgacgaccctattgcgacaagatgctgggaaaatcttagtcaatggctttgattcattgtcgcaagcccgacgcgttcgccagcagtttggtttgaccggtcaaaccgctagtatcgatcaggacctgagtgcgcgggaaaacttgcagatttttgggcgcttgaatggtttaagccgtgcggcggcgaagcatcgagcgatggaattactgacggattttgatttgaagcattctgcggatcacgttttggccacattttctggcgggatgcggcgacgattagatttggcggttagcttgattggtaaaccggccattctttttctcgatgaaccgaccacgggcttggatccgcggacaagagcgcagatgtggcaagcgattcgtaaactagtggccgatggttcgactgtggtgctaacgactcagtacttagaagaagccgaccagttagccgaccacattgcgctcatagatcatggccagttagtcgccagtgggacgcccaccgctttgaaacaaacagtagggggtcaagagcttgaattggaagtcagtgcgacgacggccgtcacaccggctaaggatatcttacaagccatgctcggtcaagatgtccgtgttgcggaacggaccctaacagtgccgttggataccgctagcttgacgccggtcactgaaattctgatgcggttacaagctgctcaaatcacggtcagtaactttgcgatgcacgcgccgtcgctcgatgatgtgttttttaaactgaccgtgggcacaaattagaggaggacaaagcgatggaaatcaaacaaccagcagagttaagtcatgttttgacaatgacgcatcggaacttattaaaaatgtggcataatccagataatgttagtgacgtggtgatacaaccaattatttttaccctattattcggttacttgtttggtggggccattgcgggcagtgtccaggcctatttaccaatgctagttaccggtattttgattcaaagtattttgaatgcagcatcgggatccggacagcaattacgtgaagacattaacgcgggggtgtttgaccgcttcaagacgctaccgatttcaccgatcgtaccgttagccggtcagttagtgggggatgttttccgattgcttatttctggcttgatggcactggtgacagcttttatgatgggctggcgacctattgttagtccgctagtattgatcggcgttttactgctggcagtatttgttggatggtcgctttcatgggtctttgctttagttggtttaatggtcaaaaatgcggccctgattggcagtctgtcaatgatcattattttagtgctgacctttttatctaacgcctttattccgactaagacgttaccacatttgttgcaaacaattgtccgattgaatccggtcagtctaacaattaccgcgatgcgcacaattttgcggactggccattgggggcccgatgcatttggtgtactgttaagtggtttccttattattgtgatttttatgccgttaactgtgttggcatatcgccgatttggttaacggtacgctaaaaatagtgtgtgttgcggcttaatgaccggcagcgcacactatttttgaaatggggaattactgcccgttcgaaattgatggtgatgaaaagtgtcagataagtggagactgatacttgcgagggccaatgattggccgcaattgttgttcgtggtgccaacaagcgataatgagcaaaataataatcaatacttgcatagaagataaaacgaagtctgtcaatccataggctagaatgatgggcaaagtcatcataaagtaacgcaaattcggcgtacgatactggtgccaatatttggttaagtgccagccactgctgaggactaagtaaataaagccggcaccgcctaggataccaaaagaagctagtagcatgagcaaaatatcgtgggcgtgtgggacgtaggttcccgtcagttgcaaatagtgccgcgcaaagccaaaatacgtcacgccgaggtacggggcctgtttgaaaacggtgaagctgttgtgccaaatcgtcaagcgactttgaagtgcggtgatggtcgaagcacttctagggaaaacgtgccagacaattaaactgccagcaatcaagattgttgtaaccaaaatgcgatggtgacggcaaagctggtaagtcgtcatgatcagaatggcaatcatgatcatgagccctgtgcgcgatttggtttgataaatgcccacacaaagtaagccgaccaaaaaccagtttatgagcggccagcgcgtgaaggggtgaacacttccatgacttaactgtgtcaatagtaagccgagggcaatcaataataaacagcaggcatcatttggattataggcggacccgaacaagcgattctgattagcagcatagccccataataggtcacccagcatgaacttcagccacgttggtaatgtcaatacttggttaagccagtggaaagcaaaaccgctaattgtaatatacaagccaaattggatgataaatttacgaagctcgtgccaagcaatcgactgcgtggactcacgacacaacaaccaaagattgcccaatacaaaaagcattaggacagacagaataacactacgataatcgtggtgattgagattgagcgtcgtgatgcccattaataggacgataaaccctagcaacgggtcgtgccgactgaattgtcgtggatgtttgagtaacgccagccattgccaccggcttaaataaatcagccatccgatacctaccggcggcagaatagctaataattttaggccagtcaaaaatggcgacgtcgttaaaagacgttttcgcatggttaatcaaactttctctcattaaataatatgtcgcttgccagtcgacattagccatattatggcacgtctgcctgtcatccaaacttgcattaatagaattttagttagtttgaacaaagcttaggaattttcaggaaaatttaaccagctgaatgcgtattcacagtgaagcatggtaaaatatgattagtaacgtacggtgatacgggtgctatcctgaatcaccattgaaatgcgttggtttttaaggtcaaagatgattggccaacaaaggtctaatctagtgtgcgacctttgttcagactgctaacttccaggccattgggtattgccatgatcttagttgaacctcgttgggtatttctgataaagagccgacccgtaattcaacgaccagcacgtttcaattttggtgcatactaaggatagcgagtgacgtgcgtggttagttaaactgaataattaaaacaattgaaccgggtggatttgaccacaaccactgaaagttagtcgtgtgggtaaatcttcccgaattaaaggggaactgtatgtggatgcaaaacaattatcaaaacgattagcaacggttggcgctttcgttcagccgggcgcccgcgtggccgatattgggtcagatcacgcttatttgccagctaatctcgcattaaatcatcaaattagttatggtgtagctggtgaagtcgtccgggggccctttgaaaatgcgcgtcatgagattcaaaaactggggttaacggatcgcttagtggcccgtctagctgacggtcttgctgcgattgaaccagctgatcgtattgatacggtcacgattgccgggatggggggccctttgattcgccatattcttgaacaggggccgacccagctcgccggtgttcaacggttggtactcgagcctaatgttggtgaagcgaccgtgcgggaatggctggcggccaatcagtttcaaattgtagctgaacgaattctagctgaagatggccatacttatgagattctttgtgctgatcgggttgatcatcaggtgacgtatacgacggctgaacagatgtttggcccgtttctgctagctgagaagtcgccggtgtttatcgctaagtggcaacgtgagttacaacgagtaaatgcggcggttgcgcaaatgcaacgggctaaagtgataccagaggaacagttagcgctggctcacgctaaaatcaaattgattgaaggagtcttgacggatgcaagcaagtgaattaattgcgcgttttgaaaaatttgcgccactcaagttgaagtgggagcatgatcccaccggattacaaatcggcgatcctcatcaggacatccacaaggtgttagttaccctggatgtgcggccggaagttgtccaagaagccatcacgatcggtgctgacatgatttttgttcatcatcccgtcatgtttcgaccggctaacaatcttgattatcaggatcctcagaaagcaatgtatgcagaacttgcagctcaccacatcttggtgtacgcggcccatacgaatctggactgtgctgagggcggcatgaacgattggctggcggcggccctagacttgcaaaatgtgcaggggttggttcctgggtatcgggcacaggctgttaagttgactttaacggtaccgaccaatcaagttgaaacggtacaggaatacttaacgaataccgtgggtgccacgctagatcgttacgctgtcaactcgggtgaacagttcagcgtcgacttactagccgatcagattccaactgcggtagcgggcattaatgacttagccgctgacacgtgggattaccaggtcgtgccactgttgtctggcggtcatcagtattatatgggccgagtcggtgatttgccgacaccgttatcagcgcaggcgtttgccgaacagtgtaagcaagtatttggtgtcagcggcctgcgactagtcagtgccgatccccgacaacggattacccgtgtggccgtcctgggcggcgatggtggtaagttctatccccaagcgttgcaagcaggtgcacaagcttacgtgaccggggatgtctattatcacaccggtcacgatatgctggcagccgggttgacggtcattgatccaggccaccatatcgagagtatttgtaagtcacaactcactaagctgtttgatcaatggcgtgtacaagctggctggccaatcgagattgtggcgtctcagctgaatactgatccgtttaccttcatctaagttaatcatgaactttaataaggaaaggaagttatcatatgtcaaaatatccaaacttaatttcagattttttaacctttgtcaaaattaatagtcgttcagatgaggaatcaacgacaattccttcgtcaccacgtgaaacggcctttttaaagcaattaatgagtaagctcactgatttaggcttgagcgatgttgaacaggatgcgcaaagtgcgtacgtttttgcgacgattcctgcgaatagtgacaaagctgttaaaacccttggcttcatttcacatattgatacggctgactttaacgcggaaaatgtcaatccacaaattgttgacaattatgacggtgaatcagttattaagctcggaaacggggactatgtgctggatccggcggtcttcccaaacttaaagaactatgctggtcacacgctgatcacaactgatggaaccacgctgcttggagctgatgataagtctggtgttgctgaaatcattagtgctgcggaatatttgttggcccatcctgagatcaaacatggcaagattcggttagcttttggtcccgatgaagaaattgggactggtgctgatcactttaatgtgcctgcctttggcgccgattatgcctacaccgtcgatggtggtccgcttggtgaactggagtatgaaacgttcaacgcggcccaagcgacggtgacgattacaggtgtcaacgttcatccaggggaagctaaggataagatggtcaacgccttgcagttagccgttgattttcaatcggcgttacccgcacatgatgtcccggaacacacggaaggccgtgaagggttcttcttcttgcttagtttagacgggaccgttgacagcgctaagatgacttacattattcgtgatcatgaccgcgataagttcgaagcacgtaaacggttatttatggcggttgcggatcggctgaatttggctgacggtgtggcccggatcaaggtcgacatgaaggaccagtattacaatatgcgcgaaatcattgaaaaagatatgcgggtcgttgaattggccaaacaagccatgctcaagctcggtatcacgccagccatttatccggttcgtggtgggacggatggctccaagatctcatttatgggcttgccgacaccaaacttgtttgctggtggtgagaacatgcacggtcggtttgaatacgtttcagaacaagtgatggcccaagccgtggacgttgtcttacaaatcgttcaggataattatgaccaggactaaatccttgaccttgtttgaccttacgggttatactctaatggtcaataaaggtcaaacaaaaattggcagctatgacggctgcctttttgctaccgtttttgaggaggtacgtaaatatgaatccagaacaatttacagaaagtttacaacaagccttacaacaggcacaacaaatcgcacaaacacggcgccatcaagaaattggggtgccccatctatttaagtttttaacgcaaccaggcgaactggttcggcagatctttagtgaggccggcgctgatttagaccaattacaaacagagctcgaccgtgagctggatgatattgccgttgttagcggtggtaacgttcagtacggtggcagtatgagcagtagtctagctacgctgatgcaggctgccgatgctaagcgcaaagcgttaggtgatgattaccttgcgaccgacactttggctttagcgctgatggatcaaactggtgatcagttgaccaaatacttgaatcagcaaggcatcacggcaggacaagtcaagaatgccgttgatcgtattcgcgggggtcaacgggtaacgtcacgtaatcaggaagatcagtatcaagctttggaaaagtacggcgtcgacttggttaagcaggcgcgccaggggaatcaagatccagtaattggccgggacgaagagattctggatgttattcggatcttgtcacgaaagacgaaaaataatcctgtcttgattggtgaaccgggagttgggaaaactgccatcgtggaaggcctagcgcaacgaattgttcgcggtgatgtgccggagaacttaaaagataagacgttgttctcgctagatatggggtccctgattgccggggcgaagtatcgtggtgaatttgaagaacgactcaaagccgtcctcaaggaaatcaagaagagcgatgggcagatcatcatgttcatcgatgaaatccataatatcgttggtgctggtaagacagaaggcagtatggacgccggtaacttgttgaaaccaatgttggcgcggggagaacttcatttgatcggggccacgacgttagatgaatatcgtcagtacatggaaaaggacaaggcgctcgagcggcggttccaaaaagtattggttgctgaaccgagtgttgaagatacaattagtattttacgtggcttaaaggaacgctttgaaatccatcatggtgttcggattcatgataacgccttagtggccgctgccaagttatctgatcgttatattacggatcgttacttgccagataaggccttagatttagtagatgaggcttctgctgaaattcgggtcgaaatgaactccaacccaacggaattagaccaagtcaaccgacaattaatgcgtttagaggtcgaggaagccgccttaaagaaggaaactgacgatgcctccgttaaacggctagcggatgtacaaaaagaactcgccagcgcaaaggaaaaacagcgggctttatccgaacgctgggacagtgaaaagaagagtctccaagcgctaagcgacaaaaagtcggcgttagacaaagctaagcacgacttggaaaatgctgaaaataattatgatctggaacaagcagctaagttgcagcacgggacgattccaaagctggaacaagagttgaaggccatggaagccaatgatcatcatgaagattggttagttgaggaatccgtcacgccagatcagattgcaaacgtggtttcccggatgacaggaatcccagtagccaaactggttgccggtgagcgggagaaattattacacttggcggaccatttgcatgaacgagtggttggtcaggatgcggcggtcgatgccgtttcggatgccgtattacgttcgcgggccggtttgcaagatcctaatcgtcccctgggttcttttatgtttttaggcccaactggggttggtaagacggaattagcgaaagcattggctgagaatttgtttgacgccgatgatcatatggttcggatcgatatgagtgaatatatggagaaagagtccgtttcgcgattggtcggggcggcaccgggctacgttggttacgaagaaggcggtcagttgaccgaagctgtccggcgtaatccgtactcgatcgtgttattcgatgaaattgaaaaggcgcatccagatgtgtttaacatcttgttacaagtattggatgacggtcggttgacggatggtcaaggacggaccgtcgacttcaaaaataccatcttgattatgacgtcgaacttaggatcagagttgctactggcgggggttgatgaccagggtcacttgtcggccgacacccatcaacaggttatgcagctggttcaaagtcgattcaaaccggaatttttgaaccgaatcgatgacatcattatgttcacgccactacaattgggcgcgattgaggaaattgtggtgaaattgattgatcggttgtctgcccgtctccaagatcgtgagattacactgaaaatttctgacgaagcgaagaagtggatcgctaagcaggggtatgaaccggcatacggtgcccggccgctccggcgctttatcacgaatcacgtcgaaacaccgctggcaaaagagatcattgcggggcgcgtggcaccaaaatcgacagtcgccattaatttgatggacgatcacttagtcttcgaaaaccaatcgacccagccggcataagcgtaatcactgatttgaacgcgtgataatgcgtttcagtgacgataattgggccaataaaaactggaccgtgagcaccttgcgatgctcacggtccagctttttttaggcggattattattgtgacttggttgagcctatgattctggatggcttgatcgtgtaggtgtgaggcagctatctttggtttatgatgatggtagccgcgcttagcttcggacgagggggaccttgcgcccgtgcgtttaacctcatactgagaaaagagttgttaccgccgacgctgtcgtgctaagctactccaaaatcgaggagtaagcgaacatggacgacgatcgtaaaaggtttgaccagtatgcaaaaaatgaattgaaaaattaatgtacaacgtggttctttatcagcggccgatttggcattttgggcagcagcgcaaagcagaaatatgccaaaacgctgcaaatgctcaaagcaagtgatggatcgtaagcgtcattaatctgaatgttagggtcgggtatgtaccagcattctagttggctggcgcgtcaagcacacaacaaaaaaagacgagtaactgcaatcgggatgctcgtctttttttgttgtgctgagactaagcgaagcaaagcctttggttgtttttaattacttattatctgaacctttagcgggttgggaatgattagtaatataagtgatgctgttgaccacgactagcgcgaaaattgcagcaacgatgccgatttcaccaaagttatagtccaactgttcaagagcaccaccgatgtagccgatgacctcaccgaagaggacactccaaaagataatcgtaagttgtctcatcattttccgacacctcccaatgaaaattattttaacacaccgacaggaaaaagcaattaggtaataacgggatattaaggctttaattaggttgatataattacgacgagacggcggtgaaaccctagttatccatctaaaaataaccgtgcacgttatctgatgacttaaaactgccgcttagaacaactgtttggtataatgaatagtaacgaatatatctgaggacaagattggtcatcaactggcattgaatagactggtaaattctttgtttacccatcaatttggagcgggcttgacgtagctgatctgatgttacgttttcgatgcgagttgaaagctgatattttatgaaagggggcggcgatagtggcacaatatgttccattgcaagtattgagtacttttagtttacttcacagcactagtacagttagtgagctagtccaaactgccaagcaacaggggtattccacgttggctttaacagacgttgatatcatgtacggtattgttgatttttataatgcctgtcgccaggcagaaattaacccgatattgggaataacattgaacttattaggacgtgaactaacggcgcaaacgtttagtctggtcgtgcttgcgaaagatcaagctggctatcaaaacttgatgcggttgtcgacgatgaagcagacggcgacggatgcaggattgtcgctaacagccgtattaccttatttgaaccatttaatggtcttaaccccggctaaagacagtgaactagctgcgctgttgttacaaaacaccgctgagcgagctgctgattggattaccacgctgaggcaggcggtcgactctgctagcctttacttagggatttctttggatcaggcccctgcattgcgaacaacaatgacggcctttgcgcaacagcatcaattgccggtagttgcgttagatccagtcgactatgtccaagcaaaggattactttgccgtttcagttttgcgagcaatcgatcggggccaacagatcgaacagcccgaatcgttacaaggtatcgaaggcagtcactacttacggccggccaacaccgtaacggctgactatgagcaactgggattgacgacggcggtggcggctacggccgaaattgcggcacagtgtcaagttgaattacaatttcaacagccacagttgccgcaatttccaacgcccgctggacaaccagcgaacgtttatttacggcagttatgcacggctggtctaacggagcgattggcggcaataacgccgtcggttgatcagcaggcttaccaggaccgtttggatcacgaactgaccgtgatcgatcagatgggctttgatgattactttttgatcgtgtgggatgtcatgaattttgcgcatgaggcccagattacaactggacctgggcgaggttctgcagcaggctcattagttgcttatgcactcaatattacggatgtcgatcccttaaaatatgacttgctatttgaacgtttcttgaacgctaaacgggcgaatatgccagatattgacttggatattccagataatcgccgtgaacaggtacttaattatgttcatgataagtatggtcatgaccgcgtcgcacaaatcattacgtttgggaccttggcagcaaagcaagcactgcgcgatgttggccgtgtgtttggcctctcaacttacgagatgagtgactggagtgccgcaatcccaaaccaattgcatattacacttgaccaggcctaccagggctcacaacggttacaaaacctcgttgctgattcatctaaaaataaattattatttgaaacagctcgccgtttggaagggttgccacgacattattcaacacacgcggccggggtggtattaagccaaaaaccattaattcagatcgtaccgctacaagcaggtagtgaaactatgatgatgacccagtatactaaggacactgttgaagcggttggtttgttaaagatggatttcttaggattacggaatttgtctttgatggcaagtgcgctacattatgtgcagcgtcaaactggcaggccactggctattactaaaatcgatttgaacgatccagcgaccctgaaattatttcaggcgggcgacacgaccggagtcttccaatttgaatcggcgggaattcgaaacgtgttacggcgtctgcacccggataactttgaattggtcgccgcggtcaatgcactttaccggccggggcccatggaaaatatcgaccattttattgcccgcaaacaaggccaagaaccggtcagttatccggcggaacaacttgcgcccatcttaggaccaacgtacggtattctggtctatcaagaacaagtcatgcaagtcgccgcggtcatgggcggttttacactaggtgaagccgacttattgcggcgggcgatgagcaagaaaaaacgtgctgtgattgataaaatgcggcaacaatttatcgctggtgcacaacagaatggttattccgaagcagttgcgacacaggtttatcaatatattgaacaatttgcgaactatggtttcaaccgctcacacgcgattgcctacagtaagatggcttttgaacttgcttacttgaaagtccattattccggagcgttctttacctcattgatgaattctgtgttgggcaatggaacgaagctgaaacagtatctagcggaagctcgtcagcaccaagtggcgattattcccccggatattaatcggagcggtcaatactttgattggaatggtcaagccattgtgtttggactcagttcaatcaaagggttgcgccgtgactttattgcgagtgtgttagacgagcggcaggcgaacggaccgtttaaaagtcttcagcagttcatgcaacggattgacgcgaagtggctcaaagccgatttgatggatgcactgatctatgcgggggcttttgaccactttggtttgaaccgtgcagagctactgaccagtgtgcctgaattgatgtcaagtgccgagttagccggtggcagtatgagtttatttgaatcattagcccctaagatcaaaaaacagccggagatttcgttaggtgagcgattggccaaagaagcggagtatcttggtgtgtacgtttcagggcaccctgtggaaacgtatgattggctcgcgcaacaacgacatacacaattagtcagcacgctcacgagtgaacaaccggcacaaatactggtctatattactaaggtccgaacgattcggaccaaacgtggtcaaccaatggcatttgcaacgggaagtgatttgtccggcgaaattgacttgacgatttttcccaatacctatcaacggattcaggcggaattgaaaccagaagcaatcgtgttaattactggtaaggtcgagcaacagcgggatttgcaagtgatcgtaaacacctggcagttggcggaacaattacccaaaccaaccggccaactctttttgcggttgcaacctgagcaagcaacggcgactgtgcaaaaggaaattttaaggatcttaagtcaatatcgaggtcctaatccagttctaatttactcggtagcagcacatcgaacggttgaactaaattcacagtattgggtcgcagaaaatccagatttggttggagcgcttacaaccttattaggtcgcgataatgtggtgatgaagaacgctatcccttgatacgacggcgttttttaacgcatttaattttagaaaataacagacaatccacgtgaaaagtgttagaatcacttatggagttacgaactcaatttattgcctgaggtgaaaaaatgaaacgcattggtattttaaccagtggcggcgacgctcctggtatgaatgcggccgttcgtgcagttgctggtaaagcaatggctgaagggttggaagcatacggcatcaattacggctttgctggattagttgccggtgacattcacaaaatagaagcagccgacttagatggtgtgattcaacgcggcggaactttactatactccgcacgttatccagaatttgcccatgaagaaggtcaattaaaagggatcgaacaattgaagcggtttgggattgatgctttagttgttatcggtggcgacggttcttaccatggcgcattgcgcttaacggaacacggctacaacacgattggtcttccagggacgatcgataatgatattccttacacggacttcacaattggttttgacactgctgtcaacaccaacgtgcaagctcttgaccggatttatgatacggctcatagtcatgaccggactttcgttgtggaagttatgggtcgtggcgctggtgacgtagccttatggtccggtgtttcaatcggcgcgactgctatcgtggtccccgaagttgattgggacatggaagaaatcgccaacaagattaagcataaccgggccaatggtcatcggagcaacttgattgtgttagccgaaggtgtgatgggtgcccaggagtttgttgagaagttatccgaatatggtgactttgatgctcgtgggaataccattgctcatatgcaacgtggtgggaatccaactgctaaagaccgtgtcatggccagcaagatgggtgcctacgctgtggaactcttgcttgccggcaagggtggcttagcggttgggattcaaaacaaccaattagtcaaccacaacatcttagatttatttgaatctaagcatgacgttgaagtgtcattagataagttgaatgaagaaatttcattcaagtaatcatggcatgttagttcttattttaatttgataaaaatgacgttaatgtctttttataaaaactttcaagggagagatttttcttatgaaaaaaaccaagattgtttcaacacttggtcctgccagcaccgatactgacactattgttaaattaatcgaagccggcgcaaatattttccgctttaacttttcacatggtgatcatgaagaacatttagatcgcttaaacaaagttcacgaagcagaaaagattacgggtaagaccgttggtatcatgcttgatactaagggtgctgaaattcggacgaccgttcaagctaacggaaaatctgaatacaagatcggtgacaaggttcgtatcaccatggatgattcattagatacgacccatgataagattgccgttacttacaagaacctctatgatgatgttcatgtaggtggccatgtcctctttgatgatggtttattagatatgaagatcgacgaaaaggacgaagctaaccgcgaattggttacaactgttcaaaacgccggcgttttaggctcacgtaagggtgttaacgctcctggcgtttcaatcaacttacctgggatcactgaaaaagactcaagtgatattcgctttggtttggatcatgaaatcaactacatcgctgcttcattcgttcgtaagccacaagatgtcttagacattcgtgaattacttgaagaaaagcacatggaacacgttcaaatcttccctaagatcgaatcacaagaaggtatcgacaacgccgatgaaattcttaaggtttgtgatggtttgatggttgctcgtggtgacatgggtgttgaaattcctgctgaaaatgtgccattggtacaaaagagtttaatcaagaagtgtaatgctttaggtatgcctgttatcacggctactcaaatgttagactcaatgcaagaaaacccacgtcctactcgtgccgaagcttctgacgttgccaacgctgtctttgatggtactgacgcaacgatgctttctggtgaaagtgctaacggtctttaccctgttgaatctgttgccatgatggctaagattgacgaaaaggctgaaaacactttggctgaaaacggtacgttacaattaaaccgtttcgacaagactagtgttactgaaacaatcggtattgcgattgctcgggcagctaagaacttgaacattaagacgattgttgctgcgactgaatctggctacactgctaagatgatttcgaagtaccgtccaaatgctgatatcttagcaatcacttttgacgaacggactcaacgtggcttaatggttaactggggtgttcaaccaatcgtggctgaaaaaccagaaaccactgatgacatgtttgatttagctgcttctaaggctgttgaacttggctttgccaaggaaggcgacttaatcttgattactgccggtgtgccagttggcgaacgcggtacgactaacatcatgaagatccaattaattggttctaagttagctgatggtcaaggtgtcggtgatgaaacggttatcggtaaagccgtaatcgcaacgtctgctcaagaagctatcgacaaggccgttgaaggtggcgtcttagttactaagacgactgacaaagactacttaccagcaatcgaaaagtctagtgctttagttgttgaaaacggtggtttaacttcacacgctgctgttgttggtatctcaatgggaattcctgttatcgttggtgttaaggacgctactagtgttattgctgatggtcaattgatcacagttgattcacgtcgtggccttgtataccgcggtgcttcaaacgccctttaagatcaaatctaatttgatattgaaaagtcgtcgctttgcggcggctttttatattacataaagtgcttcactcccagttaaattagtatgaaacatggttaaaaggtgccaaatcgtcaacgtcaaatgatccagcttaagcccgctggaaaaagatctacttagcggaaatttacttagctagcggcgtcctataccgacttccaggcatttcggccaattgctggaacgcggtggacacagatttaagccgaagaccacgtcttaaatactggtcttccactaaccaagccaaaaacgcttactaagtggaatttcaccgctgagcattggccgaaacgccttccagtcgtgatagtatgcgaatggccgacatgggtggacccagcattgaacgaattagatgttgctattttaaaacagcgattttatcatacaacagttagtttgataatataattgtgattgtacgattatttctaattccaccgtattagtactgaggtgtccaaaacaattgagacagcattaacgcatgttcaaaattctaagtagtaaacccgttcagcgacaagttaggtggtcgttcatcagccattcgactggcttaccgactggaggggttgggtgacaatgctcagtagccaaattattcttggctggaagtgggttgcttccggcctagaataagactcgtatttgagattgcacagtgggttgctgcgtgagctcaaatcgacgtcggctacgttccggcaattgtcacccagccccgtaagtcggaataggacgaaccttgctgacgagctggaatccaaacgatttggcaccttttaaccctgttcccgcctaaattaaagaacaggaatcggttattgatcagggggggatagtgaaattggtgagtaacgaccaacacccctcgtaattcgggccattttcagttacaattgataacacgtgaggtgtcgtatggaaagttggttatttttattagcgattttagtggtggcatggttaggaaaaaatcagtccttacaaattgcgaccgtggttgtgttgcttatcaaattgattcctaatacgagtaaattgctgacgacgattggtcagaagggaatcaattggggtgtgacggtgattaccgtcgcaattttgattccgattgcgactggtcagattggatttcgggacctttggcatgcgtttaagtcgccagttggctggattgcggttgcatgtggagtgttggtttcagtgctctcatttcacggtgtcgggcttttgtcagcgacaccagagattaccgtggcattagtattcgggaccattatgggtgttgttttgctcaagggaatcgcggccgggccaattattgcggctggtataacgtattgcattattcaagtcttacatttgagcttacagtaatttaaaagaaccatccgttgatatttatagacggatatattagaggagttatcacatggatagtattattggaacagtggttacggcgaaggtaaccgatgaaaacgatgaagcatacttcgtacagattgatggacagacgttgtgggtcgataaaactgaaccagagaagccattgcacattggcgggctttacgaaggttttgtttatgagaatgaagatcatcatctgcagatgacgcggtttgtcccggaaatttcgtttgatcactttgtatggggaacggttgtccggacgcggcatgatctgggtgtctttgtcgatgttgggttaccgaataaggacttggtggtgtcattagacgaattaccgaccatcagtcgactatggcctaaaaaagatgatcgtttatacgttaagttagcccgtgacaataaacaacggctatgggcgactctggcagaattgacggattttgaagcaattgccaagccatatgatcgggcccaagttaagaatacggataccatggcgaccgtttttcgtttgaagatggccggtacgtcggttattacagatgacaatcatctgggctttgttcatccgtcagaacgtgaacaggaaccacgcatggggcaacacgtcaaggcgcgggtcattggtttcttgcgcgatggtgaattgaatttgtccttgaagccgcggggatacgaagagattggcgatgatgcccaaatgttattagcagcattgcaacatcaagctgaccacgcgctaccattttgggataagagtgatcccgatgatattcggaattactttggtatcagcaaatcacaatttaagcgcgctgtgggtaatctcttgaagcaacgcttgatcagtcaacaaccaggcgagatcaagttactggaaaatgcggatgagcaagccgacgattgatcaaaaaatgcaggaccagcttgctgattacctgcattttttgcgtgttgaacgggggttagttgaaaatacgattaagagttattctcaggacctgactacgtttagcgaatacttgatgagtcagcaaatcacggactatcgggtggttgatcggtacgtcctattgaattatttacagtatctagatgaggctggtaaatcgcgaaatacaatcattcacagtgtttctagtttacgtaagttttttcaatatttagcacagatgcacgctatcgatactgatccgatgctaaaaatcgacacgcctaagcgggcgcagcatttaccgcaagtattgtcaccacgcgaggtcgaacggttgctagcggtgcctaagttgaataccccgttaggattacgagaccgaactctgttagaagtgatgtatgcgaccggtctgcgagtcagcgagacaattaatttaacgatggatgatctgcatttagacttgggattgattcaaacaatcggtaagggtgataaagagcggatcattcctatcggtgatgttgccattgattttattacccgttatttaaaaacggctcggcccaaactcgtctctgccaaacgccggaatagctatttgtttattaataatcacggtggtaaattaagtcggcaaggggtttggaaaaatctgaaggcagaagtcaaggcggctggcatcgaaaaaaacgtgacgccgcatacgttgcgccactcgtttgcgactcacatcttagaaaatggtgcggacttgcgtgtcgttcaggagcttttagggcatgccgatatttcgacgactcaaatttatacgcatatttcgaaaaaacgcctagctgaggtttataataaatatcatccgcgggcatagatgcggtgcggaatcaagcagtcaagggaggcaataccgtgctcgttaaatatcggaaggattatgaaaaggtagcaatggggctactgtcatttattccagattttaaggacctaattcatctacaaactgagatgcagtggtatcagtcaacggaagaccatcaactattactatggcggcaaggtgacggcgatttctgtggtattatcggcattgaagtcggcagtgactttattctactgcatcacgattcattatcacccgaggaacggacggcggccaaccagtatcaaatgttggatgagttggccgcgttgtatcccaaacaacgggtcatgggaactttagaaatggcgccaatcattggcgcgtgggagcgtaatcgtgacaaacaaccaacaacaaccaatcaccattaagatttcggagtttgaggggccactcgacttgctgttgcacctcattcgccaaaacaagatggatatttatgacattccaattgcggcaattacgcagcaatatttggattacttacactctatgcgagcgctaaaattagatattgctggtgattatttggttatggctgcgactttgatgacgatcaagagccgtttcttattgccacagcctgaaccagatgagatgaacgaagataatgaggacgatgatcctcgtgactcacttgtagctgaactgttggcttacaaggtttatcaggaagccgctggtgaattgcgagaaaaagaacaggcgcgccatcaacattttacgcgtgaagcgatgttagtaccagctgatctgagtgcgcccaagctgactgcggggattacattagatgatctgcaagcggcttttcggcaattagtggctaaacggcggcgggtacggccactaacgaaaacggttgtggctgaaaccatcaacattgatgagcggatgacacaaattacgacgcaattgcaacatcaaccacaaggactggattttgccgacctatttacggttagtgccagcgatgaaatgttagtgacaacctttatggctgtgttagaattaaccaagcaggatcaagtggcgctgcagcaagctgagccactgagtccgattcatttatatttacgacaggatgaacagcatgacgaacattgaacaaattgaaggactattatttgtggctggcgatgagggcatcacggtcgccgaaatcgagcacgccacggggtttgctaagccggcgattacaacgatgctcacacaactggccacgaagtatcaagccgacccagacagtgccttaatgatcttatcaacggcgaatacttaccggttagcaactaaggccgcggtggcgccggtgttaaagcgctactttgaagcaccactcaccacgagtttgtcgcaagcatcgttggaagtgttagcaatcattgcgtatcggcaacccttgacgcggattgaaattgatgagattcgtggcgtacacagtgggtcaacgattcaaaagctggttttgcgacaactagttaccgagacggggcgtttaagtgagccaggacgaccaattttatacggaacgacggaactgttcttagattattttggactaaagtctttggatgacttaccagcgattgacttagctgctttaagtgacgctgagcatccggcaccagagacagacctctttttaaatgcatttcaggataaattacaagcagaacgtgaggatgaataatggcagaacgattacaaaaggtaatggcggaagcgggcatcgcttcgcggcgtaaatcagaagtgttgatcacgtctggtcacgttaaggtgaatgggaagacggtcaccacgctcggtgtaaaggttgagcctagtgaccatgtcgaggttgatggcgtgccattgaatgcagaaaaactcgtgtattatttattttataagccgcggggagtcgttacaactgttcatgatgagaagggccgtaaaacggtattagacttctttgaagacgtaccggaacgaatctatccggtgggacgtttggattacgatacttcaggtttgttgatcatgacaaatgatggggctctcgctaatcggctaactcatccgaagtacgaagtcaaaaaaacttatttggccaaagttgaaggggtaccaaccaatgctgatctcaagcaattgcgcttgggtgttgaaatcgatggccgtaagacagctccagcgaagtcgaacttgttagatagtgatcacaagaagaataatgcgctggtccaactaacgattcacgagggtcataaccaccaagtgaaaaagatgttggctgcagtgggtcacccagtgactaagttgaaacgtgaacgttatggggttctcgatttgcaaagcttacaaccgggcgaataccgtaaattgaagccgattgaaattagtaagttaaaaggtgaacgatagcgcttgcatttttgaacgaaagccgttaaaatgaatttgtaaaaataaatattggttcatcttcagggcagggtgtgattcccgaccggcggtaataacccgcgacctatgcgtgtgcatagtgatttggtgcaattccaaagtcgacagtaaagtctggtataaagaagatcgagcttatttgccaagcgttgcaagtaagtccgcccccagatgacagttagtgtgatcgggcggacttttttagttgaacaaatggtaatgcggttcattgaagatgacccataggagggtgcgttatgcaacatacaacgttacaccgactagtgggcatagccttactcggtgccattgcgtatattttaatgttactggagtttccgattttaccggtagcgccatggatgaagattgatttttcagatatcccaattctgattgggctctttctctttggtgtcgggggcgcgtttgtcatcactatcatcaaactgctcctacattcggccatgatgggctttgccatctatgacttaatcggttcttttgctagttttttaggtacggcagtattgattttagcatttgcattagtacttcgttactatcggggcaatcccaagtggcgaatgcctgtggcgattgtggtcgccacaatcggcctggtggtgattgaatcgttggctaacttaacgtttgttctgccattctatttgcaagtaatgggtatgaagctcagcatgtcgctgaatacagtggtgttagtggcagtcattccatttaacttgatcaagggattgctagtgggcaacgtcttctggctggtctatcagcgattagctaagtggttaggcaaccataatcagcttatgagccgaatttaatctaagtcgttaaaataatgtgggtggtcactaattgcgtaactgcagggtgactgcctttttatattggtgccaccgtgatattcttaaagacgcacactgccggttggcggatggttatccatgagctttaatgtggcagtaagttgatgaatttgaagcttcaattaaggcttagaaagattaaaaagctgttggccgctatgctttgtcgcgggtcactgtcagcgacactgacgcacgtaaatttgggctgatcacgacttaatttaaaaactggcacatttagtgcgcaattaacaattacaacagcaagacttaagggaggccttagcgtgtttacagactacgttttattgttattcagtacgacgccgcgacgagcaaagggcctattcaatgtcttgcgcggtcgccgtacggtctccacgctttttgcggggttaactgccggctacttggatttgctcgacagttgccacgaggttcccttggaagatttcatggcagcaactgcggcattgactgaaaacggtcaattgacgagtacggccacgggatgctggcaattaacgcaggcgggggaacatcggcaagccaaactccgacagactttatacatgccccgaaattttgaagtgtttcaaaccactgatgtccgccgatttagaatcgtcagtcagctagccctacaagtcgtttccgaactcgtacatcatgatcgccattattatccggtgacgactgatccggggattcaagcccaggtcaaacaatggctacgtcagcagtcgaaggtggaacttggcgagcaaattcatgcggccttgactgccttcttgacgagtttggcagacccagagttgccaacggtgtttgttcaaggtataacggggtatcaagaaccgggactgactaatgagcaattagcggcacaattaggtcgacaaccctgggaggctagcttgatgcacacggacgtgatatgccaatggattgcttggattcagcgacacccgcgtgatccattttcccagttgttgtcagtgctcactcaagcgagtgccatcagtcaaagcgctgagcaaacttaccaagctttcttgaagacccagcaacttgcagcaattgcgcagacgcggcacttaaagatgagtacggtacgggagcacttgttggaggtggcgatttggtcgcctgattttccgtttgaaatggtgttgaatcatgaaataactcagcagttggccaccatctttgcagcccagcctgacattgcaaactggtcattccaagaggcccaagctgcgctacccacgctagatttttttgaatttcggctatttcagattatgaggtgtcagcatgtcagaagatgaattatatgagctgttgaaaacgaaatatggcttcgatgaatttcgccccgggcagctagccgtcattcagaaattattagcaggtcaagatgtcttggcagtgttaccaactgggaccggcaaatcattgatctatcaactcgtcgggaccgcactgcccgggctagttgtggtggtttcaccgctgatttccttgatgcaagatcaggtggcgcgcttaaactatcaaggcgaaaagcaagttgctgctttgacctcccaactagattatggtgctcgccagtatctgttgaatcatttagggcagcttaaattcttgttcatttcgccggaaatgttgggtcaagacattattcaaacagcgctgatgcaagtgcaactggcgttattagttatcgacgaggcccactgcatttcaacttggggaccagattttcgccctgactaccgtcgccttggtcaaattcgacaacggttacaggcaccgacaacgctaatgctcacggcaacggctacacaacgcgttcgacaagatattttgacacaattaaccgttccagatgcccagcaaatcttatattcggttaatcgtcctaatatttacttagcagtcgaacaggtcaatgatgaagctagtaaacgcgcgaccttgcaacatttagtgacaagtgcgcgcggaccagtcattgtttactttacttccaagcggcaaactgatttgatagcggaatggctacgaacgacaaccacgttacgggtcgcggcttatcatgccggcttagcgactgatgaccgtttcaagatccagcagcagttcatggcaggacaattggatgtgatctgtgctacatctgcttttggaatgggtatcaacaaagctgatattcgcttagtgatccactatcatttaccgacgactttggccgactatgttcaagaaattgggcgcgcaggtcgtgatggtcagcaggcgatggcgattatgttgtacgcaccaggtgacgaaaacctggtgcggaatttgaacgaattgacggctgcgactcccaatgaaattcagcaagattatagccgttatcaagcgcagcagccaccgactgatgatcgtagtaaggttttgcagtcatactggctacaaggaactcccccaacgaccgtggcaacgatttttgctgatcgccaagtagctaaggaacgagaattgcgggcgctcatgggttacgtccaaacgacaacttgtcatcggaccgtgatgttaacttactttggtgagccagctgttacccatacagatcagtgttgtcagttggctggtgaaccactaccgctggctgcgttagggttgatggcgacgcatgatgagtcaacagccacgataatgtcgtgggatcagcacttagctcaattgtttttaccaaattcttaaagaaatcaattccgggttatgttacaatattggttgaaagttttttgaggaggaacaccctatgagtcaaaaaaatgataatgacaaatcccaagcggataagccgtgggacaaaacttttgaagacgatcgggatgactcgggcaatttatcgcgaactcaaaaacgaaaacaagacagtagcaactctacgctaacgactgtgttagtcgtactaatattgttgcttgctttggcaccaattggttatttcttggtgaaaaagaattcgcttaataatccgcaacagactgaacaagttgctagttcgagctcgaagaagtcatcggccagtgttgctgccagtaggtcatcgactgctgctagcaagaagaaggcggccgcatcgtcgaaaaaggcggctgctaaaagtagtagcttagccttggctagctctaaagctgccagttccaaggctgctagttctactgctgccagctcggaagaaagtgcgagtactgacgacagcagcgctagcagtagtagtagctcctcagaatcatcttcagggactaagtacgtcacggtagaagccggtcaaggggtctatcgggtcgctacgaatgctggaatctcagtggataagctattggaattaaatgggttatcatctgatgcaacgatttcggctggtcaacggttacgtgtccgttaatacacgattttttcagattgtgaggggttagttaatggctaagcaagcattacaggtggccatcgatggtccggcttcagctggcaagagtaccgtagccaaactcgttgcaaaacggtttggctatatttatgtggatactggtgccatgtatcgggcagtcacgtactgggcaatgcaacagcacgttgatttagcagacgaagcggctgtgattacggcaatgaagtcgctcaagatcagttttaaacccggcgagccggatcaactggtttttgctaatcaggaagatattacggcggcgatacgccaaccagacgtgacgaataacgtctcgacgattgcggcgttaccacaggtgcgtacgattttaactgagcaacagcgagagatggccaatgcaggtgggatcgtgatggacggtcgtgatatcgggacaacggtattgcccaatgctgaagttaagatctttttagttgcttcagcggctgaacgggctaagcgtcgatacgccgaaaatgtaaaaaaagggatcgacacgcccttgactcagctacaggctgagatcgaattacgtgaccacaaagattcaacgcgtaaagtgtcaccattaacacaagcaacggacgccacacttgttgatacgacgccaatgtcaatcgatgaagttgttgctgccattgccaaaattattacaaaaaaacaaagttcaacaatctaattgcattaacttaatgcttttagctagcttttcattgcattttcagctatgatataggttagagttattgttgacaggaggaaatttgcatgagtgaaaacgaaaacagccaagagaaaaatgaacttttagacgctttaaacagcgttgaagaagtaaacgtcggtgacgttgttaagggtgaagtcttagcaatcgacgacgacaaacaagtaattgttggtatccaaggtaccggtgttgaaggggtcgttcctttgaaggaactctcaacacaacgggttgacgatgtcaacgaagccgctaaagtcggtgatgtattagacttggttgtcatttctcgaattggcagcgacaaggaaaacggcagttatttactgtcacatcgtcggttagaagctcgcaaagtttgggacgatgttgaaaaagaatacgaagcaggtcatacgattaaagctccggtaacgcaagttgttaagggcggattagtcgttgacgctggtgttcgtggcttcatccctgcctcaatgattgatgatcattatgttgaagatttaaatgcctataaaggccaagaacttgaacttaagattattgaaattgaacctagcgaaaatcgcttgatcttatcacaccgtgccgttgttgaaaagcaacgcgaagcacaacgtgaagaagctttgaagaccttacaagctggtgatgtcgttgaaggtaaagttgctcgtttaacgaacttcggtgcctttgttgacctcggcgggattgatggtttggttcacgtttcagaaatctcatacgaacgggttgaaaagcctgctgatgtattgaaggttggtcaagaagtcacggttaagattttatccgttgatgctgaccgcgaacgggtttcattatcaatcaaagcaaccttaccagaaccttgggatggtattgaagaaaaagcaccacaaggggctgtacttgatggtaaagttaagcgtttgacgagttttggtgcctttgtggaagtcttccctggtgttgaagggttagttcacatttcacaaatctcacaccaacacattgcaacaccaaacgatgtcttaaaagttggtcaagaaatcaaagtcaaagtcttagacgttcgtccagacgaaaagcggttagctttatcaattaaagctttggaagaaaagccacaaactgctgacgatgacaacgaaagtcaaccagaacgtcggagtaacaataaccgtcgtcgtaacaacaaccgggacaaccggactgctagcgaacgttcaacggctaatgctcctgaagaatcaactggtttcactttaggtgatttgatcggtgacgaattgaagaatgctgaaagcaacaatgatgaaaactaatcattgattgattaaaaatacccttcaagcttgccttgaaggatatttttttaggaacagattagttggtgttaccaattaatttgagacttgtagcaggaacctgacgctacgagggtaaaggaggaattaatatggcaaaaccagtcgtcgccattgttgggcgaccaaacgttggtaaatccacgatttttaatcggattgcgggtgatcggatctcgattgttgaagatacaccgggtgtgactcgtgaccggatttacgccaacagtgaatggcttggtcaagaattcagtttgatcgatacgggtgggatcgatatcgaagatgccccattcattaaacagattacacagcaagccgaaattgcaatcgatgaagctgatgtcattatttatttagttagcatcaaagaaggcgtcacggatgctgatgaacacgttgcccaaatcttgtaccggtcgaacaaaccggtcgtgctgggtgttaataaagtcgataatcctgaacttcggagtgaagtctatgacttttattcccttggctttggcgatccgtaccctatctcaggtgcgcatggactcggacttggggacttgctcgatgctgttatcaaaaactttcctgaaaaaagtggggaggacgaaccggggacgattcgtttcagtttgattggccgcccgaacgtgggtaagtcatcaattgtcaacgccttgctgggtgaagaccgggtcatcgtttctgacgtggccgggacaacccgggatgccattgataccaagtttactgatcaggatggtgaccggtttgtgatggtcgatacggccggtatccgtaaaaaaggaaaagtttacgaaaataccgaacgttatagcgttatgcgtgcgctcaaggcaatcgataatagtgacgtggcactctttgtcatcaatggtgaagaaggcattcgtgagcaggataagcgggttgctggttatgcgcatgaagcgggtaagggtattatcatcgtggtcaataagtgggatctggttaagaaagacaaccacaccatgcaagaattcgaagcgtatattcgtgatcagttcgtttacttgagctatgcgccgattatttttgtctctgctaagactaatcaacgtttggagcaactacccgcgttgattaagaaagtcaatacgaaccatatgcggcggattcagtcgtccgttttaaatgacgttattatggatgcgattgcgatgaatccgacaccgagtgacaatggtaagcggctacgggtttactatgccactcaggtggcgattcaacccccaacttttgtggtctttgtgaatgaccctgatatgatgcacttttcatatgaacggttccttgaaaatcaaattcggaatgcctttgattttagtggtacgccgatccacatgatcgaacggcgacgtaagtaggctaaagcgcgtaaaatcagcattttagcacattatttgattgatgtaaacgattatcatctttttgcgctattttcgctgaaaaggctaaaaaagcttgctattacagcattcctatgctatctttgatgaagaaatgatgcttgttatcgtttctctcatttttggaccactcaaaaatgatcatctggatcaacgatgttaaaaagcacggcgatccttcactctgtaacggggaggtgaatcaaacatggcaaacaaagctgaattagttaacaacgttgctgcggcaactaacttaacgaagaaagacgcaactgctgcagttgacgcagtctttgcatcaatccaagacactcttgcaaagggtgaaaaagttcaactgatcggatttggtaactttgaagtacgtgaacgtgcagctcgtaagggccgtaacccacaaactggtgacgaaatccaaattcctgcaagcaaagtacctgcatttaagccagggaaagctttaaaggacgcagttaaataatgcatatcagttaatgaaatgcaaacatgaaagccagtatagcgaccgttatactggcttttttgctgtcgtctgcggtatgatagactgtcaggtcaagcgattaacagctggtatcccatgtgacgatatcaggctgactattgaaataaatgatgaaaccatggcgactaaatgaagtcgtttcttagtggtttaaaggatgggtgtaatgagttattcagaaaaaatgctcgcagcactatcaaacgggcaaattgacacggccaaaaagcactttgcatgggccttacgtaaggacgatgaccagacgctgtatagtctggctgaagaattgtacggtttgggctttttaaagcaagcggaacggacttataagaagttactggctaagtatcccgatgaggacgacttacggacaagtctggctgatattgccatcgatgaggacgatacggacctggcactcgactatttacaacaagttaagccagactcaccggcatacgttcaagcgttgttagttgaggccgatctataccagacccaggagttatttgaagtcagtgagcaaaaactcaaggaagcctatcagctggcaccggacgaaccagttgtcgaatttgcgctcgcagaattttacttcttgattcgtaactacggtcaggcgactcgcttctacttggacttgatcaagcagggacaactagagatctctaaagttagcttagttgaacgactaggggtggcttatgctgagtccgggcgctttgaacaggcggtgggctatttagaacaaatcaagcctgccaagctcacgccggacagccagtttgaattaggcttcacttatttgcaattaaacgaaccccagaaggctgttgatatcttcgacaaactgcgggaacaagacaatcagtatgcgtccctgtatccatacttggcccaggcccaagaacaacttcatcaactggacaaggcgttattaaccttacaagaaggtttagcggtcgaccagtacaatgagcagctgtacttgcaaactgcccgcttagccttgaaattagacgatcaggaattagctgaaaagtatttacgggaaggcttgagtattgaccctgataatttgactacggtattggaactgtctaatttgttagttcagcgggaacgttatcaagacaatatcgacttgttggatcaatatttgcaaagtaatgagtttgatccacagttctactggaacttggcaatctctaatgaccggctcgatcattttcaggcggctaaggataattacgaagcggcttatccgttctttgaacataacaaagatttccttaaaccagcaatttatttcttccgcgaagcaggaatggccgacagtgccgtggcagcgttgcggaattatctaacgattgaaccagatgatggtgaaatggttgcgatgctagaagactacgaggatcagggctactaggcctttagttcttcaccgcttgctgagagtttcattcctaaagttattgaaaccactttcaattttggtaaaatgaacgtatatcaaattcaagtgaggcgtttactatcgtgaaagtagctataattgccaccgatttagatggcacgtttttgagagacgaccatcagtttgatcaccatcggtttcaggcccagttggatcaaatgaatgctcagggccagcactttgttgtggcgagcggcaatcagctgcaacattgtattgatgtttttgacgggatcaacggtgaattgacctatgtggctgaaaatggcgggttagtcattgataatcacggcaacgtgttggctgaaagcttgattgagccggcgctttatcaggaactgttagtttacgtggcgactgaaccagcactggctggtgctgagatctcggtctccggcaagcaaggggcatatattcggccccaagatgacagtccaatcatgcggtactatttgagccggctgcaagtggtgccatcgctatcagcaattgatgaccatatctataaagcgacttttagttggcaagccacggatgctgatgcgcacgccgctttgatcaatcagcaatttgctggccggttacgggcaactgtcagcggtggtaatgggcttgacgtcattccaccacatgttaacaaggcaaccgggcttgcttatctccagcagcattggcacgttgcccctagtcaaacggccgcgttcggtgataacggtaatgatcttgaaatgctacgggaggctgattatagttttgcgatgcaaaatgcgattgcacccgtcaaagagatggctacgtaccttacgtcacatgacaataatcatgatggggtgttagcgacgattgacacgttaatttagcgtcaccaggtgttgttggcggccgaaatgtataagcaaatagtgttcgaccgagcgggactacgctttgagtcagacactattttttattcatatcagtgttataggacggacgtggctcgtctcacaaagtagcaagttaattagcgggaccgttttagccattgggtacgaacaaaatggggctagtttaacagtttaaacaggttcggcgaggattctcctgcctaatttggcaattgtctgctaaaatataattagcttaatcttgaggaggaatttattgtggtaaaagtaattgttgccggctataagggtcggatgggtagtacggctgctcagatggtcattgataatcctgattttgaattggttggggtctatgacgcgcgcagtggagaacaaaatctaggtgaggacgaccgctttaagggtcaagacgtgccagcttttcatgatttagaccaaattaagacggatgccacggtctggatcgactttacgattccaaccgccgtttatgaaaatgcaaagtttgcacttaaccatggtatttcgcctgttattgggactactgggatgaccgatgaacaagttgccgagttgcaaaaattagcaaaggacaagcaagtgggcggcctcattgcgcctaactttgggatcagtgccgtcttactcatgcaatttgcccaacaagcagcgaagtacttcccagatgttgaaattatcgagatgcatcatgacgataagattgactcgccaagtggtactgctatcagtactgctaagaagattgctgaagttcggcaaccaaaggaacaaggtaatcctgacgcaactgaaactctacctggcgcacggggtgccgaatatgaagggatgcggattcacgcggttcggttacctggactagtggcgcacgaagaggtcatgtttggcggccctggtgaagggttaacgattcgccaagattcctttgatcggatctcatttatgactggtgtcaaagtggcggttgaaaaagttaaccagtatcacgaactctttgttggtttggagcacttactatgattttgacgcagttgccagctgagtttcaagcagctaagccgattattgagacgatcgaagcggccggctatgaggcgtactttgttggtgggtgtgttcgcgatacgattttgggcaagcccctacatgacgtcgatattgcgaccagcgcgtttccggctgaagtcaaacaattatttaaacggacggttgatacgggaatcgagcacggaacggtgatgatcttagatcatggcaatggttatgaaacgacgacgtttcggactgaatctggttaccaagattttcgccgccctgatcaggttacgttcgtccgatcattgaaagaggacctgaagcgccgggatttcacaatcaacgccttagccatgactgctaacggtgaagtgattgatctgtttgacgggttagcagatatggaacaaggaatcttacgcgccgttggagtggctgaagaacggtttcacgaagatgcgttgcggatgatgcgtgccgttcggtttgcaagtcagttaggctttaccattgaatcacagaccgaacaagcgattgccgataatgcggcgttgttggcgaaaattgccgtggaacggacgcgtgtcgagtgggagaagctgctgatggggcagcacccagttgctggtttgaccggcttgctgaccactgacttgtatcgttatatgcccgcaatggctgatcaagaagcgatgttgcggcagttaatggcacttccagcttggcatttgccgagtattgaaagtacttggaccttgcttagctggaccatgcaacggactgacgaagcggctgttcgccagttgttaaagacgtggaagacgagcaatgagctgattaatcacgtgacggccgctattaaagcgctgatggcgttaaaacacaacggtcagttaactgcgcaggagaacttttatacgggcttagaggcgctgaaaacggctaatcaggtggctacgattttaggctttggccaggaccaagcacaattggtgcaagcttatgctagcttaccaatccatgacaagcatgaattggccattaacggtggcgatttattgaaagctaaattggtgacgcctgggccaatgatgggtcaaattctagcggcttgcttacaggccgtggtgatgaaacaggtcccaaatcagcaggatgctttgcttgattttgcaaggatggtagcggattcaaaaaaccattgatattttctatgaatctgttacgattaaagtgaaactaattcaatgaggtgatttgaatggaacgagcattagaagcattgaaatttcattttcggaatggtgacacttggacagttcatcatcaagatatctctgacctgtggatcggccgggtaacgacgagttacggtcgaattaagggtggccatatgaccatcattcatccttgtaaatcatttaaggctgaatttaaacctgacgctgatgcgatcgatccggacacgacccaactatcatccgtgacaagtgggatgtttgaacgggtgacgcattatcaagacattgaaaaaattgacatcctgtttggcgacgaacgtggtagtgaacaaatttacttgccattcaagccacgggatgcggatggtatcgacaacatttatcagacgagctcattagccagcgatggaaaattacacttagtcgttgatgatgaacggaccgtctttgatgtttatggtgatcataactaataaggtgttgccaaacaactcttggggccgagtgagcctcaggagtttttttgtgactcacgacccaatcgaatcgatgatcgttaggaaatattaacgttgatttgcgcgtttgtcagttgtgttttaagccgattctagctaagatagaacttaatgatgtaaaaaaaagggtggatcgtaacaatgcaaactttaagagcagaaaatctgacccgaacttatggtgagaagacgttatttcacgatatttcatttattgtgaatgaacatgaccggattggtgtcattggcgttaacgggtccgggaaaacgaatttattagacgtattagctgggattacggcaccggaagccggtcaactggtgatgcccaaaaattatacgattggttatttaaagcaaaagccggaacttgaccagaatctgacagtcattgatgccgttttggccggtagtcagcaagtctttcgaacgattcgccactacgagcaaacgttggccgcttatgctgatcatcccgaagaccaagcgacccaaaaagcttacgtggccgctgaggatcgaatgaaccaagaagatgcttggacggctgaaagtgatgtcaaaacgattttgacacaactgcacattaccgacctgacgcagaccgtcagtcagatgtcggggggccaacagaagcgggtgggcctggcgcaagtgttgattcaatcaccggatcttttattactagacgaaccgaccaaccatcttgattttgactcaattgagtggttagaaagctatttagctagttataagggtgctttgattgtcgtgacccatgaccggtatttcttggatcaagtcgccaaccagatgtttgaattgtcatttggcgagctgcataagtatacgggaaattaccaagatttcgtgcaagcgaaagccgaacgggtcgcccgtgacgtgttagctgaacataagcaacagcagctgtacaaaaaggaactggcttggatgcgtgcgggagcacccgcgcgtagcacgaagcaacaggggcgcatcaatcggttcaatgatttgaaggataatttgaatacgctccaagttgataacgatgttgatatttcgctcggtcagcagcgtttgggtaagaaagtgatcgagttaaaggacgcgagcttgcagtttgatcggcaaaccatcctggatcacttttcgatgttgatccaagccaatgatcgcatcggtatcactggaatcaacggtgccgggaaatctagtttattgaatgtgattgcgggtcggctgccacttgatagtgggaccgtgacgatcggtgagaccgtcaagatggcctattatactcaacagaccgaaccgattccgggcgacaagcgcatcattaattacttgcaagatgtcggtgagacggtcttgaataagcagggcgagcatgtttcagtgactgagttactagaagagtttctgttcccacgttcgatgcacggcacgctgattcgcaagttatctgggggcgaacagcgccggctatacttactgaagttgttgatgcaacagccgaacgtcctcttattggacgaaccgactaatgatttggatattggtacgttaacggtgttggagaactacctcgatgattttgccgggaccgtcatcactgtttcccatgaccgctattttttggacaaggtcggcacgaaactactgatttttgatggtcaggggcatattgaacgctattctggccgtttctccagttatttgaaggatcaaaaagacgcggccaagcccgcagccaaggccactgcgacaaaaactacggctaagccggtcacggatgactcgaccgcaccattggccaagaaagccaaagtcaagctgacttacgcggaacagctcgaatacgacaagatcgaaggggttatcgagcaattggatagccataagagtgagatcgaagcggcgatggctgccaatgccagtgattatggcaagttggctgatttgcaaaaagaattgactaagacggaacaaacgattgatgagaagatggatcgctgggactacctcagccagtatgcagaagcctgaaaggatgatcgcatgttagaagatagttatttacaactcgcgcgcaccattttagaacacggcacgtataaggatgaccgtaccggcacgggaacatacagtgtgtttggttaccagatgcgctttgacctgagtcaaggcttcccgttattgacgaccaaaaaagttccctttggactgatcaagagcgaattactatggtttttgcatggtgatacgaatattcagtatttattgcaacatcacaaccatatctgggacgaatgggcgttcaaaaattgggttacgagtgccgattatgacggccctgatatgacgaattttgaacaccgccggctagatgatcctgactttgcgccgatttatcaagctcagatgcagacctttgatgaccagatcttgacagacgacgcgtttgcggccaagtatggtaatttgggtgacgtttacggtgcgcaatggcgtcactggcaaacgcgtcagggaaagacgatcgatcaaattgccaatgtgattgaaatgatcaagacgcatccggattcgcggcggttaatcgtttccgcttggaatccagaagatgtgccgaacatggcgttaccaccgtgtcatactctgtttcaattctatgtcgcggatggtaagctctcttgccaactctaccaacgttcaggcgatgtcttcctaggtgtgccattcaatattgcgagttatgcgttactaacacatctgattgctaaggagacgggcctagcagtgggcgagttcgtgcacacgttgggtgacgcgcacatttatactaaccatgtggaacaagttaaaacgcagttgacccggcaacctcggccagcaccccagctgactttaagtggggctcgtgacagtatttttgattaccaaatgagtgacattaagctcagtggttatgatcccgcaccggcaatcaaagcgccggtcgcgatttaggaggccgcaatgattgcattgatatgggcagaagatcaaaatggcctgattggcaaccagggtcagcttccctggcatttaccagcagatatgcagcggttcaaagcgctgacgaccggacaccatgtcgtgatggggcgcaagacttttgcgggctttaaacgcccgctcccacggcggaccaattgggtgctctcacgtcagtctgatttaaagttgccaccggaagtccatcaactagcagatgtggcggcgatccaaacactcgcggctgcccatccggatgaaccgatttttgtcattggtggtgcggtggtgtttgaagccgtgttaccggtggccgattatttatatcggacgcgtatcaacgcaaggtttgatggtgatacttggatgccggccgtggattacacgcagtggcagctggtgagccaacaaattgggacggtggatgagaaaaatcaatatccgtacgaatttgatgatttccgccgtcgttaattcagtggcaaccgtgaaactcaggcagatttctgctatactgaaagcattaattttattgtaacgatcgtttaaacgttacaagtataagaaagcgtggcaaagtatgacgaaaatcaagattgtgaccgattcttcggcaaatttgacggatgccgaggtaaaaaaatacgatattaccgtgattccgttgactgtcatgatcgatggcaccatttacgtggaagatgaaacgattacgcgtgaagaatttattgacaagatggcaacggctaaatctttaccaaagacgagccaaccggcactcggaacgttcattgaaacgtttgataagttaggtgcggatggcgcgagtgtgatttgtatcaatatgctcgaagccatttcaggaacagtgcacacggcggaacaagcggcttcgattacgaagaccgatgtcaccgtgatcgacgctcggacgaccgaccgtgcgatggcctttcaagttttgactgctgctaagttagcccagagtggtgctgacaaacaggcggtcatcgatcagattcatgcgactcaggcccataccaagctattcatgggcgtaatgaccctgaataacctcgttgctggtggtcgaatcagtcgtctgacgggggcaatcagtacgctactgaatgttaagattgccttggaagttgatgacggcaccctagatgtgaagatgaaggggcgcggtgttaaggcgattaataagttttttgataaggttctcgacgatattattgcaacgccgaacgtcgccgaagttgcaatctctcacgttggcgccacggagcgcgtggaagaatatcgggcgcgcctacaagcggctttaccaagtctcaagatcagtgttcaaccaacggtgccaattattgcgacccatggtggcccgggtgcgtttgccgtggaatatcatacgcaagcgccagcgtaaagtgagcggtgtcccacaggcgacttgtctacgagcactaatggcaaatggtgatcgtcccaacaggggatggtgaccattttattgttcaaagatgagttagctctgattaaatggactgctcaacggtgaagaaaggttggatgccaatgtccaaagttaaagaaaccatcaaaatcattttagtggtggcggtgttagcggtcggggtgtttttcggggtcaattatctgctgcatccgcaaaatgaatcggcgccgactaccccaacaacgactaaaaagaccactgccaagaagacgccccataaggcgaagatcaacttggtcgcggtcggtgactccttaacggaaggggtcggcgatgagtccgagggtggctacgttggtcagatcaaaaaaacgttgacgactaagcaaaagctgaaggtgacgaccacgaatgctggtaagtccggtgatcggagtgaccagattttagcacgcattaataagtccaaagtgttacaacagaaaattgccaaggcggatgtgattaccgtgacggttggcggtaacgacctcttgcaaacgctcgaagggtccctaacttctaacaatacggccaaaaataacgcgacggttgctaaagcgcaaactttatatgcgaataaactaactaaattatttaataaattacaaagtttgaatggcactgcgtcagtttttgtctttagcatctataatccaatttatgtgaactttccaaatgtgacgtcgatcacgcactacattagccagtggaatgatcagacacagacgacggttagtcaatacaagcacacgtattttatggatatcaattggaccatgtcacacggccagtacaagacggcagcccagattcgcaagttgaagaaagcagcgagtgccactaccttaactagcttaaccagctcaaaggccattactggcgctttagagacagaaaacaagacgaatgatttgatttcgactgctgataatttccatcccaataagcgggggtatcgtgtgtttacaaccaaactgtatcagaccatgatggcccatgatgcgtggttaatcaaaaaatagggaggtaatgagatgcgggaagcacaacgaaacaagcaggcatcagcacctaaaaatccgaagacaaacggtccaatcaatgtttggaaatgggtcgccgttgtcttgattgcgttgattgtcggcaccggtgcttacgtcggcacccaggtcttacgatcgcctagcgaaagcactagtttgacggctgcaagcaatacggatgcggctagtgtgccgattacaatgaatcgaaaacaattaaacgcccttgcgagttattatttgaatgatctacaaaagggccaagacatgaaatatcgcttcgtggtccggtctaccggcgcttatttgctcggaacgacgcaggtactgggtcagaacgtgtcgtttgtgatcacgatgcaaccaagtgtcatcgataacggcaatatttcgttgaaagcaaccaatttatcggtcgggacgatgtccttgccaatcagctttgtgattaattatattaataataattacaagacacctaagtgggtcaagttgaatgccaagaagaagacaatcgacctctacttgaataaattagttggtaaacatgatgttcgttatagtgtagataagcttgatttgaagaataatcagttcaagttcgaaatgcatattccaaaaactagtgactaaggagtgaattcatgcataaaacattttatacattcttgatgacgcaacggaacccagacagtaccgatgccattgccgaatttgccaataatgcgtttttggatcaatcgtttccaaagcagagtaaagattttcacgaactctcacaatatttggaattgaacgctggttatttgccaacgatgacggtctttgatgacgcgtggcaagcctatttggcaagtgaagcttaaattaatttgtaggaaagaggacgttcggtatgccagaggaacccaaacaaactaatccgcacataaaaaaagtgccccggcccaagcgacgcgttggtctatggacctatattatttccattgtcgtcgcattaggcattggggtgggtgggacgtactggctgattggtcggcaagtcaatgcccagctcagcagtatgcagcagactagtaaagcaatgaaaaagatcgaatcagtttatgaaacgatcaatgagaattactacaaaccggtcaatgcgaataagttggccaacggtgccattaacggcatggtcaattcgttaggtgataaattttccgagtacatggacaagagcgagacggaaagcttgaatgacacgatcgacagttcgttttctggaattggtgcccaggttcaaaaatctggcaactatgttcaaattatttcaccaattgctggtacgccagctaagaaagctggtttgaaaccgaaggacattattaaggcggtcaatggcaagtcagtggccggtaagaccttgacacaagccgttagcatgatgcgtggtaagatcggtacgacggtcaaattgacgattgaacgcagtggtcaaacctttaccgtaagtttgaagcgggctaagattccagtgacgaccgttgattataagttagtcggtggcgataagaagatcggttatattacggtatcgaccttctcgacgaatactgctaaggaatttaagacggcgttgaaggcactcgataagaagggggccaagaagttagtcatcgatatgcgtggtaatcctggcgggttgatgacggctgccttgaagatggcctcaatcttcttgaagaatggtaagacgatcatgcaggtccaagcacgcgatggttcgaccgaaaaatacacggcgtccaagaagtatgatggtggctttaaagaaacgaagccaacgaccgtcttaattgatggtgggagtgcttcggcagctgaaatcttctccgcagccttgcatcaatcggcaggtgttaaactggtcgggtcacagtcatatggtaaggggaccgttcaaacggtgacgacttttaatgataagactgagatgaagatcacggtcgcgaagtggctgacaccaaacggcacttggatcaacaagaagggcttgacacctgatgttaaagctgatgagccgagttatgcaagcttgacggttattagcaaggtcagtgatttacaagctgacaaggtcaatagcaatgtcaagacgttccagaagtacttgcaagccttaggttactttaaaggaaccgttaatggctactttggtgattcaaccaccagtgcggtcaagcagtatcaaaagcatgccaagttaacggtcaatggcaaggtcgataaacagacactgactaagatcgagactgaattagctaataagatcagtgataatgatcgggcttacgatgcagcaatgaaattgattgaaaagacaaattagttcaaagctgattcgtatattttaaaaggcgtaaccgaaatccgcatggctttcggttatgcctttttagttgcggaattttaatgcggtaccgtcaacgaagctttgacaagatggaggtggatctacgaattaggctcaaaaatggcttgtcacgggtgctttataaatcggcagtggaaagtcttgttcatcatgaatttaaatcaagatttagacttgccttgcggtgggggtaaagcggtatactagaaattgtgcgttaattgatcagtatgaaatagtgaatttcaacgggttggattgaggtaacttttagctgaacgactgacgagatgtttagcaattatagaaagaagttttgttgtgaatcgacgggccatttattttgttcagggcgccctgttactatcgaacgttatggctggtatcgatagtacgaatgtgaatacggcgctaccagcaattattgcggatttacacggtctacggttaatggcgtggatcgtcgctgttttcttactaggaacggcagtttcgaccttgatctggtcaaaaatgggtgagcgctttggtaataagcgagcttatcaaatgacgacggcactctttattgtcggctccttactacaaggattagcacccaacatctggtttttgattattgctcggggtgttgcgggtctcggcaacggggggatgatttccttaccttacatcatgtatgcggacatttttaagaatccgcgtgatcgaatgcgggcactgggactagtctcggcttgctttagtatggcaacgattattggccccatggtcggtggtgtgattgtcgatgtgtggtcttggcactggatcttttacctcaacgtaccaattgggattgtctcagccgtgctgttacaaatcttctatcaagaacctaagcgggaacataacttgcaaccaatggatcgtgcaggggcgttattgatggcggttgggatcatcagtttgcttggtggtattgaactgatcggcatggtgtcgttatggattgtcgcgatcgtgatcgtgggggcgctcattgtgttgggcagtttaaccatcgtggaacgtcgcgctgtggacccggttattccgggccgcctgtttaagaacgcgccgttagtggtcgatttcgtcttatttgtgcttatttggggcgcgttcgttgcctttttgacgtacagtccgatgtgggctcagggcttgctagggacgtcagcgttaattgggggagccacgcagattccaagtgcttttgctaattttgggggtagtgaatcagttccccgcatgcggcggcacttgacgccccatcgcgtcttgacgatcaatattatcattttgacgctgaccttcgttccattgatgattggcggtgttaagcttccatactgggtcttactcttagctggcttctttgaaggttggggcaatggggcctgctttaatgagctgcaggttaaggtccaagtagacgctgatcaacgtgacattccagttgcgacttcgtttagttatttgattcggatgctcagccagacgtttaccacggctatctttgggctaatcatgaaccaagctctgactagtggggtggcacgatcggatggtaaaatcaccatggcgatgatgaaccagttaagtgatgctagtcgggcgggccggctaccagcgcacctagtgccgatgatgcgtggcatcttacacactggactacaaaatatcatgattgttgcgttcggattaatgatcgtcgctttagtgatcaacttatgggcacaacgtcatgagacgcaacggcaggcccagagctagatagcatgtgcaaacttgatttttgcaatgatgattggttcggaacaacttacggagaggtattctaattgaatacctctttttattctgtgcgatgcttgtatcgctgaattactaccgaaccggaattcatccaattggcagattgttttaatcatgattgaaggtgactgtcaagctgtgcctatcagttgcatttaaagagataatacgatatattaacatcaactacttactaaaagtaagcgaaacaaaagtaatgggggcattaagatgattgatgttaatcaactagaatttgggttagaaacatttggggatattgtggcgaaaacggatggtagtttacagtcggcgggagagtcattgcgccaaatcgtgcgcgaaggtcagttagcggatcagtatgggctggatgtttttggcattggtgaacatcaccgaccagactacagtgtctcaagtccggaaacggtgttagcagccaccgctgccgtgacccagcacatcaaattagcgtcagcagtaacggtgctgagttccgatgacccggttcgagtttatgaacggtttgcaacgttagacggcctgtctaatgggcgcgcccaagtgatgttaggacgggggtcgtttaccgaatcgttcccgttatttggctatgatttgacggattatgatgacctatttaacgaaaaactcgcactatatgaccaattgcgaacggaaaagccggtgacttggtcgggtaagtttcgggcttcgttaacgaatcaagacgtgtatccaaagacagctactggtgaacttgagacttacattgggattggtggttcaccagaatcaattattcgcgcggctaagattggctataaagtaatcattgcaatcatcggtggccgggcggaccgatttaaaccgtatatcaaactgtatcacgaagccgctaaaaagttcaatcagccagcttatccgattgcggtgcattcgcatggattcattgcggatgatcaggatgaggccttgacggtggcttatcaaaatatcaaagctaattttgatcgcattggattgacccggggatgggcgccaatgagtcacgaacaatttgaccgtgaaacaaaatacgggtcgttttatgttgggacgccgaccgtggttgcgcaacggatcgcgacgacgattgaaacactagggctggggcgctttgacttggtatacggggccggtaatcaaacggcggctcaacgtgaacggatgattgaattgtatgcgacacaggtgattccacaagttaaaactattttacaagcgaagcaggtgacgaccaaatgacagtcaaaaacgttggaatcctcggcgccggtaaagttggtatcgtcttagcggaactggcattggcggccgggtatgacgttcgcatttcgggctctggcaaagtaagcaaaattgaactaacgattcaaacactagttccgggtgcaattgcgtcggaaaatcaggatgtcatcgccaacagtgagttaattattttagcattaccgctgagtcgttaccggcaaatcccggctacggcgcttgatggcaaacttgtaattgacgctatgaattattggtgggaaacagacggggtacgggaagaagttctggatccccagacgtcctccagcgaacaagtccagcaatacttcaaagggagccatctggttaaaacactgaaccatatgggttatcataatctgcaagaagacgccagacctaatggcgatccggcgcggaaggccctattggtagctggtgatgagccccaagccgtagcaactgtggcccactttgtggagacgcttgggtttgatcccattagctatccccgactggcgaatggtattatgactgagcccggcagtccgttatttggggccagtttaagtgcgaccgcgcttcagcaaatcattgatcattttgatgaaactgattttggtcgtgcgcttgcggccaaacatgcattggatgttgaaacaaacgagtagctaaaccaaactaaaatgcggcattcaacctgaatgtcgtattttttcgtgatcttagttggttagatggggaaacgcacaacgcaagactaattcaaacatgatagaataaattttgaagccgaatattgacagtttgctgtgtcaaaaaatagttggcattaaatttgaaagttggcatttgagatgagttataagcgttggaatgtagagaaggcaatcgttttagcactacgggaacttggtggaacagccccacgaaaaataatacgccagacaattgctacaaatgaatatgttaatctgaagtatgaggatgtctatgatactaaagtcagtgcacggaccggaagagcgtataatcccttcctatacgatttcaactttgggttaaaaaatctacttacagttggctatattagttccatggaatggggaaaggaaatttcactgacaagtatcggcagaactgctgaattatcaaattatccgacctctgaacaaacccaactagttacgaactattggaatcaaaagacacgtgaaagagtacatcggaaattaacagcaatgcaggaatctgatgacaagttggcagatagggatgaggatctggtcgtaatcgatgatccagagtcgcgacaagatgcagatgaatcacaatggaagagtgatttaattgaatgtttaaaaaaattcaattctggaaagtttgaaaacttttcgcgagcattgatttcaaaaatgggtgtgaccattgataaaaatcgtggtgtggtacgttcagctgatcacggtatcgatggctttggctattttaaatccgacgagtttcgtactagccgggtggcaatacagtgcaaacggtatacgcaggaccaggtatccgaacctgaaattgataaatttaagggtgtcatggatagttttaatgctgaatatggtatctttgtgacaactagtcatttcactaaccgagctaaagctaaggcgatgcagggaaataatacggtaacactaattgatggtcaggagttagctgatttagttgaaaaatatgaattacagattacccctattaaaacatatactttaaatgcatattattatgaacaagattgattgaattttgagtgtgttgaaatctcatcaataaattaagataaaaaaactgatatccccgctgagttaatccatactcagcgggggttttgaaaaaggatatatatgatgtttaaatggtttaggtgtcctgctttagtgaaggcgattgcggtttggacattaaagccttgatcaaattgcaaaaaacaactcgccactgtatgttgttaacaaaaaatgaattcagtcacgtcatgtgtcgatcagtcaattattattaaaaacgtcaaagccatatccttgaatgtgctgtttcaatagtgtcaaatagcgctgggccgtagcgctcaattcgattttcttatggcgcaggtatccaagggtcattgcatcatccacttttagtggaatcgccacaattttttcgtcattgagttcactgctgatgatgcctgaactgatcgtatagccgtttaaacccaccatcaagttgaagatcgttgcccgatcactgatgcggatatgctttttatgaggtagcgtactgaggatttcttctgcaaaataaaaggaactcgtatcgccttgctcataagagaggtagggatagtctcgtaggtcatccaaagtcagttcttgcttgtgcgttaatgggttatcacgaccgacgaaaacgtgcgggcgagcctcgaatagcggtacgaagcttaagtctttgtcagcaatcaaacggctaagcacggtctgattgaacttattaagataaatgacgccgagctcgcttttcaaagtctgaacgtcattgagcacgttggccgtttcagtctcgcgtaatgtgaactgataggtatcgccaccaatttccttgactaattcgacaaaggcgttcacgacaaacgcatagtgttgcgcagagacactaaagatacgcttgcgaacggttccctgaccaaaatgttcgttgagtaaattaacttggtcgaggacactgcgagaatagttaatgaattcacggcccgcatccgtcaaagtgatccccgttttatgacgataaaacagttgtacttgatattccttttcgagttctttcattgcttgggataatgagggttggctgataaataactgtttggccgcctcgttgatcgagccagtcgtggcaattttttctaagtagcgcaattgttgaatacgcattaagtacacctcctgagaaatgtctggtttcagtatctaattaacgcatgattgtagctggtgtgattgaataaattatttaggttatagttattgcctattatatcatcaatgcaatcagtcttatctattttttaatcagattgttataataaactcattaagacagacacggaggatgattacattatgacaaaaacacatttccaattggtcggttcactcttacgcccggctagtttacttacttataaaaatcaaatcgaacatcgtgacgatattcaatacccattttatgaggctttgccgggctaccaggctgccgaaacagcggcagtgaagacggtgattgccaccgaaaaggcgcatgggattgatgtgctaacggatggcgaatatacgaagtcaatgtggcatttggattttatttgggggtttagtggtgttcggcggttcattgcggatgaaggttataattttcgcgatcatgacggcagtgattttgaaacacgtaaagatattggcattgaaatcacagcaccactgtctggcaagcatcatcattttatcgatatttatcagcaacttaagtcacaagccgatggtaatgacgttaaattaacgatctggagtcccgcacacgcctttgttgagtttggatacatcgataagctatatggccctgaccagatttacaaaactgttgatgacttgcatgcaggtttactcggggcgtataaagaattcttaacggattatcaagctgcgggtggcaaaatcatccaattcgatgactgcttgtgggaagtgtttgccagtgataatcagcaaagtccctttggtgctggaaatggcagtctccaagaattagctgatgtagccgtcaacaccaataatgagttagttgattttggccatcaattagggttgaaagtttggacgcataattgtcgtggtaattatgaaagtcggcactttgcagaaggcagttacaatacgattgctaagaaattcctgcatgaccaacactacgaccgtttcttccttgaatgggacgatgaccgcgccggtgatctttcagcgctcaaggtacttgaggaccggccgaatgtggaagtcgtcttgggcctgttatccagtaagaccaataccttagatgatgaagatcgcgcgttacggttactgacgcaagctagtcaaattttgaataagaaccagttatatttatctcatcaatgcggcttcgcttcgtgtgactcaggtaacgagttaacggcggctcagcagtgggcaaagattgatcagggacaaaagattgcggctaaattctgggattaagtcacgtcagttaattagctgacggctatcaaacgacaatcaaacaagcgcgatgttgcggccatcttgatgatgaaggctgtggcgtcgcgcttatttgcagttgtagtaggtgaactgtgtgtatgatcgtatcggtggacgttaacgttaaggacggttatgcgatgtgcttggactaacgagctaattgacagctaccgcaagcttgcagccaataaaatggggtcgatgttccggttagctaaattaacgtgtggaagtattgggcagcagatcaatggtcggtttcaaagcatggtcggtgtaaacatggtaaaatatagattgctgcatcatgccagtcctggactagcaagcgtccggtgttttagttcatgggcggcatagcgaccaacgatttcgttgaatgaacgcattagtggcggttggtgcacagcacttaagcatgtcgccactggagctagcagcatcggcttgacagccagtgccgttaaagaattttaacaatgatcaaagtttgaaggcattcacgccacgagaaaaaggagcacaacgtaatggcaaatattcaatggtacccaggtcacatggccaaggcgattcatcaaattcaggacaatttacatttagttgatattgtttttgaattggtcgacgcccggatcccagtggcttcccggaatccagaaattgaaaaaacggtccaacaaaaaccacacctcttaattatgaccaagaaggacttggcagatccccaagcgacagctgactgggtcaagtattacgaagaccagggtcaagttgcgatcgcggtcgattcacgtagccgtacgattggtaaacaaatgacgcaagcggctagtgacatgttagctgacaagttagcaaaaattgcggcccgtggcattactaatcggccaatccgcgcagtttgtgtcggtatccccaacgttggtaaatcgaccttattaaaccatattgtcaataaaaaaattgccaaagtcggtgatcgtccgggcgttaccaagggccaacagtggctcaaagcgtccaataaattggaattactcgacaccccagggattttatggccgaagtttgaagaccaagtcgttggtaccaagctggccgtcacgggtgcgattaaggaaaatatctatcctaacgatgacgtcgctttgtttgccttggacttcttcaagcagcactacgcggcacgcttagtcgatcgttatcatttgacggctgagcagttggccttaccaaatccggaattactgattgcgatgacgaaaaatgcggggatgcgcgatgactgggaacgtttctgcgtggccttcctcttagatattcgcaagggccggctcggtcgttttacgctcgacttaacgggggatcaacccgatgcctgaacgaacgattgcggattttaaacggctactggctgaccaaccaacggcagcgcttctagccgcggctcaagccgatcctcgcaagggcgtacaacaggcttatcaacactatttgcgacaagctgaaaaacaggcggcgttagtgacacggtttaatcaacatatgcgtttagaacgggatttttgggcccacggcggacaatacgttgctgggatcgatgaagttggtcgcggcccgttagctggaccagtcgtaactgccgctgtagtcttggacgatcattttgatttgctagaagtcaatgattcaaagcaattaaccgctaagaaacgggcggccctgatgccacggatcctagaagaagcggttgccgtgggaatcggcgttgcggatgcccaacaaattgatcaattaaacatttatgaggcgacccgagtcgcaatggcccaagccgtccgtaacctgtccgtccggccaacccgtttactagttgatgcgatgcaggtgccggtaccaattgaacagacccgtctaatcaagggcgatgcgaaaagcgcgagcatctcggcggctagtattgtcgccaaagtcgtccgggatcacttaatgacaatgtatgatcaagtgtatcccgggtacgactttgctgataatatgggctacgggactgctaagcatttggccgggttggccagtctcggcgctacgccgattcatcgccaatctttttcaccggttcgaaatgctaagcgggtctaaatccgtaactactctttaaagaagccgttccgttgacgactaatgtcaacaagggcgaacttaaggagtcgtgataacatgcaattaagaagtttattgattcgattacatttagcgcacggcatcgggtatgccgggatggtacgcgtgttacaacactgtcggcaggttcagacggtcgtcactgatccccgccgattaggtaagttggcccatttaactgctagtcagcaggggcgttttaccgctgattggcaaagtatggcgtttcaacagcgactaaaacgccatgcgcagcttgatattttaacaatcttggatgatgattacccaccggccttattagaagcctatcaaccaccattagtgttgtttttgcgcgggcagcgtgcgttactaacgacacgtcaacttgcggttgttggtgctcggcaggccacatcgtatgcggaacgggtcacgacgcaattattggcaccgttagcaacggcaaagttgaccattgtcagtggactagcgaagggagccgatggttttgcacatcggaccgcccttcgttttaacttaccgacaatcggggtgattgggaccgggctggatattagttacccccgtcaacaccgtgacctacagcagcaaattagtcaggtcggtttactaatcagtgagtacccgctgggggtgggtccggaaccataccacttcgttgctcgtaaccggattattgccgggctgtgccaaacggttatcgtggtcgaggcgcaggcccattctgggagtctgatcactgctaatatcgcgttacaaaacaatcgcaacgttctggcggtacctggaccaattgatgcaccattttcagttgggtgcaatcaattgatcgttgcgggggccaaaccagtcttaaattcgcgacatataatagaagagtttttaccaaaaatttgacaacacgaaatttttgaaatatgattacagggatttcttaaactgatatttataataatgataatgaaacctgtaaggagctgatcgagtggctgcaagtacaactaaagccaaaccggcggcaaagcggaagaccgcaactaaaactgctaccaagcggaaaagcaaaacacccgctaaaaaattggtgatcgtggaatcaccatctaaagcaaaaacgattgaaaaatatttaggtcgttcttataaagtcgtcgctagtctgggccatattcgggatttaccgaagagcaagatgggtgttgacgtggataacgactacgaaccgcactatatctcgattcgcggtaagggtgatgtgatcaaaggattgcggaaagaggctaaaaaagccaaagccgtgtacctcgcatctgacccggaccgtgaaggggaagccattgcttggcacttatcctatttattaggacttgaccctaaggataaaaaccgggtcgtcttcaatgaaatcaccaaggatacggtcaaaaacgcttttaaggaaccgcgttcaattgatatggacctagtggatgcccaacaggcccggcgaattttggaccggttagtgggttactcaattagtccattattgtggaaaaaggtcaaaaaggggttatcggccggtcgggtgcaatcgatcgcgctagatttgatcattcaacgtgaaaatgaaattaaagcgttcaaaccccaagagtattggacgatcgatagtgaatttcaaaagggtcgttccaaattcatggcaagtttttatggaacccatggtaagaagcaaccgttggatgacaacgatgcggtgcaaaaaatcttgggccaattagaccggaatggcgattttaatgtcgtcaaagtcgtcaaaaaagaacgtaaacggttcccggcgtcgccatttacaacctctaccatgcaacaggatgccaaccggaagttgaatttccggacgcgtaagaccatgatggcagcgcaacagttatatgagggcatcaacgttggtggtaaggaaggtagcgtcggcttaatcacttatatgcggaccgattcgacccggatttcgtcgattgcgaagcacgaagcgtcacaattcttgcataaagaatacggcgcagaatatgcggccaccaaacctgtcaagggcaagttaccagaaggttctcaggatgcccatgaagcaatccggccttcatccgtcttccggacaccagctagcatcaaagactacttgacgaaggatcaattccggttataccagctgatctggtcacggtttgtggctagtcagatgacgcctgaagtacttgacacaatggcggtcacgatcgaccaaaatgacgtccaattccgggcgaacgggtcgaagacgaagtttgctggttttacgaagatctacgataagacggaaaagaataacgtcttaccagatttaagtgaaggtgatgtggtcaagttatcgaagactgatccgcaacaacacttcacccagccacccgcacgttactctgaagccaacctcatcaaagcattggaagaaaatggtgtggggcggccgtcaacgtacgcaccaaccctggatacgattcagcggcgctactacgtcaaattagaagcgcgccggtttgtgccgactgaactcggcgagatcgttaacgatattattcaggaatacttcccggatgtcgttaatgtcggctttactgccagtttagaagaacagttggatgcgactgaagaaggtaaggaaaactgggttaaagtcgtcgatagtttctacaagccgttttctaaagaagtcgcaacggctgaggaaagtatggagaagatccaaatcaaagacgaattagcgggcttcaattgtgatatttgtggcgcgccaatggttgtgaagatgggccgttacggcaaattctttgcctgctcccgtttcccggattgtcgtaatacgaagccgatcgttaaagaaattggtgtcgtttgtccgcaatgtaagaagggccaggtcattgagcggaaatcgaagaagaaccggattttttatggttgttcccgcttcccagattgtgactttgtctcttgggataaaccggttggccgtgattgcccgaaggatggccattacctggtcgaaaagaaggtcaaaggtggcaagcaagtgctttgtccgaatggcgattataccgaaaacgttcaaaaataaatgaaaaaaaggtcatctacggatgatctttttttgtgtattgtcaaataatgcgtacaatttttgaaaatacgttgataaaattcgtaatttaaactgattaacaagtgttttatcgggaaaataaacgcccgtttaaattaatgttcgctttaagcttgacggtggacatgtcattgcaggatttgctgatgccattagttgtcttctgctagtttctcaggtatgatgacaacaatactatcaatggtatgacaacaagaaaagaggaattctggatggcatcaataccaacagtaaacgtaattggcgccggtttagccggctcagaggccgcttggcatattgctaatatgggcgtcaatgtccggctgtatgaaatgcggcccaacaaaatgactcccgcccatcacacggcgcaatttgctgaattagtgtgcacgaactcactgcgggcgaaccaattagccaacgcggcgggcctactaaaggccgaaatgcggcagatggattcgatcgtgatgcaagcggctgaacaccacgctgtcccagctggtggtgcgctagccgttgatcgggatacgttctctgcagaaatcacggctgcaatcaccgcgttacctaatgttgaaattattaatgaagaaattactagtctcccagatggcattacggtcgtagcgactggaccattaacggcagcgtccttagcgaaatcgattcaagcgtttaacgacgaagatgacttacacttttttgatgcggccgcaccgattctaacgaaagattcgatcgacatggacaaggtgtatctcaaatcacgctatgaccgtggtgaagcggcctatctgaactgcccaatgacggaagccgaatttgacgttttctatgacgcgttgattcacgccgaaatggccgaagcgcatgattttgaaaattcagatgtctttgaaggctgcatgccgatcgaagtgatggcacaacgtgggcgccaaacgatgctatttggcccacttaaaccagtgggccttgaagatccgaagacgggcaaacaaccctttgcggtcgttcagttgcgccaagatgatgccgctggtgatctatataatattgtcggcttccaaactcatcttaagtggggcgaacaaaaacgggtcttttcactgattccgggtctggagaacgttgaatttgtccgttatggcgtcatgcatcgtaatacttttatgaagtcaccgaaactattaacgccaacttatcagacacagcaacggcccaatttattttttgcgggccaaatgacgggcgtcgaaggctatattgaaagtgcagcgagtggcatcgttgctggaaccaacgcagcgcgcttagcacttggtttagaaccggtcgtttttccaacggacacgatgatgggggcgatggcccactatatcacgcatacgagcgctagcaacttccagcccatgaacgccaactttggtattatgccaaaactcaaacagcgcattcgggataagcgtgaacgtaatacggcgatttctgaacgggccttggctgacctgacggcttttaaagatgaaacgttgaccgttaacaactaaaatatcgctccgttgacagggtgcataattgtgttttcctccatactttgctaaagtagcaacgtatggaggtttttgcatggaaacggattatttaaccctctttttaaagtacattcgggttgaacgacagtattcggaagagaccgctgctgcttatcgggaagacattcaagcttttaatgatttcttaacggcaaatggcggcgcgaaagcgtatactgaagttgaccggttggacgttaacgtctatttaagtcatttatatgaccggcacttgacccgcaattcaattgctcggaaagtttcaagcttgcggtcgttctataactttttggttaagaatgatttagctaaattgaatcccttcgtgtacgtccaactcaaaaaacacgcggcgcgcttaccccgttttttctatcaaaaggagctggacgtattatttcaaaccgtctatgcggatgatagcgtgatgggggcccggaacgcggcgttattagaagtcctgtatggtactgggattcggctgagtgagtgtgtcgatctacaattagccgacgttgattacgacctaaaaatgatgttgattcgtgggaagggcgacaaggaacgttacgtcccatttggtcggtacgcggctaccgcgcttcagcattacgaaaccgtctgccggcagcccgtgatggccaagtatggtcaaacgcaccaaacggtgtttattaatcgtcacggcggccccattactggcggcggaatcgaatatgtcttgaatcaaatcgttaagaaaagtagtttaacggctgatattcatccccacatgctccggcacacgtttgcaacgcagatgctgaataatggtgccgatttacggaccgtgcaggagctgttaggtcatacaagtttgtcaacgacgcaaatttatgcgcacgtgacaaaggaacatttacaacaagattatcgtcaatttttcccacgggcaacgcgggaatcgacaaaggagactgaacatgacaacgaaatttgaagcaactaccatttgcgccgttcgccaaaacggccataacgccatggccggtgatggtcaggtcacgatgggtgaaaaagtcgtaatgaaagggacagcccataaagttcggcggatttataatgatcaggtcgtcgtaggttttgccgggagtgtcgcggatgcgtttaaccttgaagatcgttttgaaaagaaactcaacgaattttctgggaatttacaacgggcagccgttgagcttgcccaggaatggcgcagtgaccaggcgttacagaaattggaagctttgttgatcgtcatgaacaaagatgacatgttacttgtttctgggagtggtgaagtaattacgccggataacgacgtcttagccattggttctggtggtaactttgccttagccgcagctcgcgcaatgcagctacatgctaaggatatgagtgccaaggaagtcgctgaagcggcaatccatattgccggcgacattgatatctttaccaatcataatgtgatctcagaaacgttgtaatgtaggaggaaacgctcatggaagaaatcaataagacaccgaaacaaattgtggccgcgcttgataattatgttattggtcaaaaccaagccaaaaaagcggtggcgatcgcgctacgtaatcgttatcggcggatggaactttctgctgaaatgcaggaagaaattacccccaaaaatatgctgatgatcggaccaaccggggtcgggaagaccgaaattgcccggcggttggctaagattgtgcatgccccgtttgtgaaggttgaagcaactaagtttacggaagtcggctatgttggtcgcgatgttgaatccatggttcgtgacttagtggacgtggctatcgagatggaaaaacaacaggcttattctggtgtgcgggcacaagcggtgcaggctgctgacaaacggctcgtcaaattattagtaccggcccaaaagaagcaggctaagaacaatggtaacgagttccaaaacatgatgaacatgtttagccagatgcaaaacggccagacccccaacgttgacgattcaagtaacgaagaagtgaccgatgaagttcgtaatcaacgattatcagttgccgatcagttgaaaacggggcgcttagaaaactcagaggttaccatcgagatggatgacccccagcaagccgccgcgggtaataataacatgcttggtcaaatgggtattgatcttggtgatagtttaggtgccttaatgcccaagaagcggattcaacggacaatgccagtctcagaggcccgagaaattttagtccgggaagaatccgaaaagttagtcaataacgctgatatttatcatgatgcgattgtccgtgctgaaaataccgggattatttttatcgatgaaattgataagattactaagggtggtcagcaaggttccggtgaagtttcacgtgaaggggttcaacgagatattctgccaatcgttgaggggtcgcaaatttcaacaaaatatggtcccatcaatactgatcacattctgtttatcgcttccggggcctttgcggaaagtaaacctagtgatctgattgctgaattgcaaggccgttttccaattcgagtcgaattagacgatttaagcaaggatgactttgttaagattttgacggaacctaagaatgcgttgattaagcagtatatcgccttgatcggtacggacaacattaaagtgacgttcacgattgaagcaatcgaagcgattgccacgattgcctataaggtcaaccatgagacacaaaatatcggtgcccgtcgtttgcacaccattttggaaaagctcttggaagaattgctatacgaaggtcctgatatggaaatgggcgaagtcacaatcactgaaagctatgtcaacgagcgaatcggtaacattgcacaggataaggatcttagtcgttacatcttataaaatttatcaagggggcgtttacgcggatgacagtcgaattaaagaatgagtacctcaccgttttgattaatgaagctggggcggaattaagtagtgtcaagtcgagtgacggtattgagtacatgtggcaggccgacaaaactttttggggccggcacgcacccgtgctttttccaatcgttggtcgtttaaaggatgaccagtataccgttgctggtcaggcttatcacatgggacagcacggttttgcccgcgacaatgactttacggtcgtcaaccaaacggccacacaagcaacatttgaattgaccgatagtcgcgcgacacgggagatgtatccgtacgcgtttcgattacgtttgatttatacgttgacggatcatgaattgaccgttaactacaatgtgcataatccagctaatcaagagctgttattttctgttggtgggcacccagcatttaacgtaccactcgctgatccggcgggcacactagctgattataaggttactgtggcaccacgaaaggtctacgcgcatattccattacaggcaccgttgaacgatgcggcaaatgcggatgacttcgacctgaccaagccattagcacttagccgggatttgtttaaggacgatgccctgattttggatttgaatcatcacgagacgacgttaatgttggacactgatctggatgatcatggggtagcgatgacgattgaagatgcaccatacgtcggcatgtggtcaccataccccgcagaagcgccgttcgtgtgcttagagccatggtggggcattgcggataacgttgatagcgacggtcaattaagccataagatgggcattaaccggcttgcagcgaaccagacgtttgatgctaaatatgcgattagctttttctaactaaaatactgtggtttagtgaaaccggtcgacaggtttgaccggtttttattgtggtctgaaaagatagcaaaataaagaattgtatcatcttactttaactagaagcaaaaaatacaaacccagcaccaaagcttacccgttcctaaataaaaagaccactcagtaatgaaatggtcttgaaagtaacataattatttgcggttagcccgttgctgacgtcgccaaccaagtccgaagtgtaccaatgattcggtcccgtttttgatacgtgcaatattactgcggtgccgatagaagatgaagagggtcaatgcaaaggccacgagtgatagcaaccaatcctgatagtaaaaaattgcaatcaacgtgacgattggaaaagccgtcatactagcaacactgaccatactggtcgtgtaaaccaataataacatgatggcactagcaattaagaagaactcccagttgtaggccaataagatcccagcactcgtggcaacggccttaccacctttaaagccgatgtaaactgagaaagtatgtcctaaaatagctgctagtccaatcaataaggtataccggttattcatatgaaatagcaaggtcggttgtagtgctgcgatggtgccttttagaatatccatcaccatgacaattgtcccagcggtcgggcctaggacccggtacgtgttggtagttccgatattaccgctacctgcttgacgaatatcagtgtgaaagaaaaacttgccaataatgacacccgaaggaatcgcgccaattaagtaggcgatgatcagcataattattattttcaaagttggttcctcctgcaatagaatcactcaatattttagcattctttttaagattgtggggattaattagtttaaaaaatgatgattgcgtgtcaaattatgaaaataaaatgattttttgataattattatgtgcctaaaagcgggtggttagggcctttaaagcgctaactgtcaaattaatcacgcattttaagaactagtcgtgaccagtaataagtttattcattgaactggcgcttagaatcaacatgaggtaagctagtaagtggcttaatttttaaaagatagttttaaacgcgaacgtgtgtttgctattttaattgttaacgtgtatgctaacagatgaagagccacaagtgacaattagaaattaacataattgtaccttgacaggttgggacttttaggactattttattacggttacctgaaagccgcacctagttgaggtagatttttaaagataaaaggagttgtgagaatggccaagaaaagcccaaaatatgatgattcttcaatccaagtacttgaaggattagaagccgttcggaaacgtcccggaatgtatatcggttctacagacggccgcggactccatcacttagtttatgaaattgtcgataatgccgttgatgaagccttagctggctatggtaaagaaatcaacgtgattattcacgccgataacagcatcaccgttgtcgatcatggtcgtgggatgccagttggaatgcatgcttccggtattccaacacctgaagttatcctcacggttttgcatgctggtggtaagttcggccagggtggttataagacttctggtgggctgcatggggtcggtgcgagcgtcgttaacgcattgtcgtccgaattgacggtaaccattgtccgtgatggctaccgctacgttgaacatttcaaagatgggggtcatcccgtcggtacccttgaaaagaaagggaagactaataagccaactggaacgacaatgacttttaagccggacgctagtatctttacaacgacggtttataattttcaaacgttggctgaacggttgcgtgaatctgcattcttactgaaaggcgtcaaaatcacgctgactgacgaacgggaaaatcaacaacaagagctggtcttccattacgaagatggtatcaaggcgtttgtcagttacctcaatgaagataaggacaccctcggggatattatgttctttgacggcactaaggaaggtgtcgaagttgaggtcgctgcgcagtacaacgatggctattcggaaaacttgttgtcattcgtcaataacgtgcgaacgccagacggtgggactcatgaagtagggttccgcagtgcctggacgaaagcgttcaatgaatatgctcgcaaggttggcctattgaaggacaaggataaaaatttggaaggctccgatgtccgtgaagggttatccgctgttatttcattacgagtaccggaaaatctcttacaatttgaaggtcaaactaaggaaaagctcggaacacccgaagcacgaacgattgttgataatattgtgagtgaacaacttcaattcttcttgatggaaaatggtgaatttgctcaaatgctgattcgcaaatccaccaaagctcggcaggctcgtgaggctgcccgtaaggcccgtgatgaaagccgaaacggtaagcggcgtcataagcaggaacggttactttctggaaaattaacgccagcgcagtctaaaaacgctaagaagaatgaattattcttagtcgaaggggattcggccggtggttcagctaaacaggggcgtgatcgaaagttccaagcaattttgccattacgtggtaaggtgttgaataccgaaaaggccaaattagctgatattgtcaagaatgaagaaattaataccatgatttacacaattggtgcgggtgttggtcctgaatttgatattaaggccagtaattatgacaagatcattattatgaccgatgccgataccgatggtgcccatattcaaattctcttactgacattcttttataagtacatgcggccaatgattgacgctggtaaaatctacattgcgttgccaccgctgtatcgattacaaaaaaagcagaacaagcagttacggacggaatatgcatggactgacgaagagttaacgctcaagaccaagtcatttggtaagggctatgcactccagcgctacaagggacttggcgaaatgaacgcggaacagctatgggaaacaaccatggatcctgaaaaacggaccttagtccgagttcgaatcgatgacgctgccttagcagaaaaacgggtcacaacgttaatgggtgacaaagttgaacctcgtcgaaaatggatcgaaagtaacgtccactttaatttggacgaagacgggtcgttactagataacgaggccgtctcatccgcacatgagcaagccgacgaagaattggcacaacagctaaaacaatagagggggtcgtaaaatggcaactgaacaaccaaaaattcaagaactaacccttgaagacgtcatgggcgaccgcttcggccgttattctaaatatattattcaagaacgggccttgccagacatccgtgatggcttgaagccagtacaacgacgaatcttatacgccatgaatcaggatggcaacacctttgacaaagcgttccgtaagtccgctaaatcagtcggaaatgtcatgggtaattttcatccccatggtgattcttcgatttatgaagcaatggttcgtcttagtcaggactggaagttacgggaaccgctgattgaaatgcacgggaataatggttccatggacggtgatccggctgccgccatgcggtataccgaggcacgtttgagtaaaatcgctggtgaaatgcttcaagacattgataaaaagactgtcgatatggtcctaaattttgatgatacggagtacgaaccaactgttttaccggcccgctttccgaacttattagttaacggggcaacggggatttcagccggttatgcaacggaaattccgccgcataacttgagtgaagtcattgatgcgattttattcctgatgaatcaccctaaggcaacgcttgaagatttgatggactttgtcaagggccccgattttccaactggggggatcattcaaggcttagcaggtatcaagcaagcctatgaaactggccgtgggcgtatcgtcgtgcgttcgcgaaccaagatcgtaccgcttaaggggaataaatcacagattgaagtttcagagatcccttatgaagttaacaaggcgcaattggtgaaaaaaattgatgaaattcgcattctgaagaagatcgaaggtatcgccgaagttcgtgatgaaagtgaccgtcagggattatcagtggtgattgaactgaagcgtgacgtcaatgcagaaggtattctgacttacttactcaaaaataccgatctacaaattacttataacttcaatatggtcgccatttatcatcaacggcccgaacacgttgggctgaaaacgattctaacggcctacttggaacatcaacgggacgttgtaacccgtcggacccaatttaacttacagaaggctatggatcgccaacacatcgttcaaggattaatcaaggcgatgtccatcctcgaccaagtaattaaaacgattcgtggtagcaaggataagaaggacgccaaacagaacttggtcagtcaattcgatttctctgagattcaagctgaagccatcgtgacaatgcaactttatcggttaaccaataccgatgtgacgcagctagaaaaagaatcagctgaactggccaaggctatcgcaacctatcagctgattctggcagagcctaaagaactcgataaagttttacggcgtgaactaaaggccgttcaaaaagcctatccaacgagccgtttgactgagattcaaaatgaaattcaagaattaaaggtcaagaccgaggtcgtgattccacaagaagacgtcattgttatgattagccatgatggttatatcaagcgaaccagcttacgctcttattcagcgtctgagcccgatgataacgggcttaaagatgaggattatccgatctatctagctaaaaatagcacgttagatcatttaatgatgttcaccaacatgggccatctcatttaccggccgatttatgaaattgctgacgccaaatggaaagataccggtgagcacatttctcagacgattgggctggctgaaaacgagcgcatcacgtgggtctattcttttgagaaccttaaagctaccggaaaattcttagtggcaactagtgacggctatatcaaacaaacggcctttgctgattacacgccgggtcgaacttataagactcgggccagccagttcatcaaaatgaagtcagacgatgcaaccgttgtaacagtcgaatacttaccagctgcaccaacgggaaccctgattctgataacgcaacatgggtatggccttcgctatgatttaagcgaggtcccaacgattggtgcgaaggcggtcggcgtgaaatctatggatctgcgcgacgatgccattgtacgggcaacaatcgccgcagatgatgatttgattgccatgattacgcaacggggttcattcaagaagatgaaggtggcagatttacccgtgacaagtcgtgcacggcggggcgttcaagtcttacgggagttaaaaaataatccacaccgggtcgctgattatgtcttagttgccagtgacgcaaatggggttgcacttgatgtgctgactgatcgtggtaagcaccattcaatcttgaatgatgatcatcctactagtgcgcgttattctaatggctcttttgtagttgatactgatactgaaggggaacctgtttctatgcagatccatccgatcccactaacggtatagtttccaatgcgaatacttgcacgttaacgggcattcgattaagataatattataacagggtaaaagattatgaattagttaagctttatttaccaataacaaccgcttgctttcactttgaatcttgtataaaattatagatatcataagatggcgataagaagaaaggatcaggtaaaattcatgaagacaactcaagaaagtattttctcatcgaaaacgttaacgtatttcttgcaactagctgaaactatgaattacacacaggcagctcaaattttaggaattacgcaaccagcattgacccaacagatcaaaaaactagagcgtaccgttggtgcccctttattttattccgttgggaaaaagttacgtctctctgacgccggttacacaatgcttaacgcaacccacagtatttatagtgtattgaacaaggcaactgatgaaatccagcagacaactagtgctactcaaggaacaatcaatattggcgtgctagcttcaattgaagaccatgtatttgaggattttgccattaagtattacgaggccaatccaaatgttattatttcgttgcacatgctgacgcgtaaagagatttgggaacgattagaaaataatcggattgatttggcagtcatgtacctacctgatgaaagtatcaagaactggaagccataccagtctaagaagattatccaagacgaattgctattcatttcgggtgacgagaagttagcgaagaagaagcgcatcaagttcaaagatacgacgctcaatccatgggtaacgtatcctgaaaactattacttggatcaagtggttaaggaatcttataagaaccagttggctgatttgccaacggcagtcgcacggtttacgacgccacaacagatttatcgctttgtggcagcaactaatactaacacggcgttgccaaattcatttatggtggctaatccggcaactgataagctccacacgttgtcatttgaaccagccatcaagtttgacttaaattttgtcttccgtaaagataaggaccaaattccgcgaatcaagaatttccttgatgaatttgatgcctacttacggaccgaagattatatttcacggttacaaaagattaatcaaaaataagttttaagggagttttgtgctaatgagtaaggaattagtttttggacatcaaaatcctgataccgacgcaatcgtggcggctaaggcgttctcatactacgaaaataagatgggagcggacactgaagcagttgcattaggcgaacccaacgaagaaactcaatttgttttggattacttcgatgaaccagcactacgggtgattactaaggccagtgatgaagttgacagtgttatgcttgttgatcataacgaacctcaacaaagtgtgagtgacattgctgacgtaactgttagtcacgtggttgatcatcatcgaattgctggttttgacacggcccaaccattattctaccgggctgaaccacttggttgctgcagcactgtcatttacaagttgttcaaagaaaatgacattgaaattccagccaagttagctggattaatgttatctgcaatcatttcagatacattactcttaaagtccccaaccacaacggaaactgacgtggcagttgttaaagacttagctaaaattgctgatattgattatgaaacgtatggtttagcaatgcttaaagcgggcactaaccttgacagcaagactgaaaaggaattaatcgatgccgatgcgaagtcatttgaaatggctggcaagaccgtgcgcgttgcgcaaatcaatacagttgacttggatgatgttttcaagcgtcaagctgctttagaagctgctgcaaaagacgaaaatgcgagtgacggctatgatttattcttaatcttggctactaatatcttagatagtaactcggaattattagtcgttggtaacccaacggaacctgttgaaaaagcctttggtaagacgattgctaacaaccggttaagcttaccaggtgtcgtttcacgtaagaagcaagttgtccctcaattaacggacgccttcaacgcttaatttacagattaatttaaaaagaagctaccacttgttggagcttcttttttgcattctagctagattggggtatgataaatactgtaattagattgtacacaactcaattatggaaggactgatagtaatggataaacagcaaggtgaattacgacagcgtctaacgcctgaacaatacgccgttactcaagaggcagcgaccgaacggccatttagcggtgagtatgataacttttaccaggaaggtatttacgttgatgtagttagtggtcaagcactctttagctcgcgtgacaaatatgatgcgggttgtgggtggccatccttcactaaaccaatcgatcagactaatcttaacgaacaccgtgacgagtcgtttggcatgcatcgaacagaagtgactagcacacaagcaaactcacatttaggtcacgtctttccagatgggccacgagatcgcggcgggcttcgttattgtattaattcagcagcactgaagttcattccagttgccgaccttgaaaaggctggttatggtcagtatcagagtttatttaaataattgagttaataaacgggaggaatttagatgacagagactgcaatatttgctggtggctgtttctggtgcatggtcaaaccgtttgatcaacagcccgggatcaagtcagtcatttcaggttacactggtggtaccgtcgctaatccgacgtatgaacaagttgccagccacacgactgggcatactgaagcggttaaaatcacttttgacccagatgtaatcagttatgctgacttggtcgaaatttactggcgtcagactgatccaaccgatgcttctggccaatttcaggaccgtggtgacagttatcgaccggtaatttttgttaatagtgaagctcaacgtcgaactgcaactgcttcaagagatgcacttgcggctagcggtaagtttgctgagccgattgtgacaaccattgaagatgcgaagccattttatcccgcagaagccgagcaccaagacttttatcgacgcaatccattccgttatcaaatcgaagaaatgggtggtcgtgaggcgtttattaagcaacattggcaataagctagatggtgattaagcgttgaaaatggctcagatttgcgatcttcgttatcgtttgagtctcatctcgataaataaggctaaaaacacgaataaaccaacctgcaaccacagcaatcgtcgctgggctagtaggttggtttttgagttcaattatgattgttaacttgcttggtacgcgtccaatgctgaataaaacgattttttgactgagtcacgaatatttaagtaagtaatataatcagataattcatgaacattactagtcaaaggaaaatcaaaatctgagtgcgcataacaagcggctggcgcgaacggaccattttgttcaataaacggttctaaccaacgatagaatgtcatcaaatcatcctttcaatactttagttaaattcaataaaactagtttaactgcaaaaaggcgcgttgtataggcgttttaaggcttcttaattaactagcaaattccacgtaatgcttgtgacgtgtttgtaaagttatgtaaagatcgtgcaacaacgtaaagttactttaactaaaaaagctaactgtagcagttagcccatcagtgtcacttagtcggttttagtggcttttaaagttcgcaaatcacgttgtcgtagcaagttttggtaatattcgaggctggtttcatctaaccgtagttgttgcatgatctcagtcggttcggtcgtccggtgttgattgagaaaccacagcatgaagtcctggcgcaatgcaaccggctttaatggcacacctaaacgttgactatcacccgccaagtatttatgcaatgccgcgagggtgatatgtgggtcggttccgcgttgacgctgctttaaaaaaggatccgaactaccactttgagtctgtaatggccgcaaataggcccgtagtttaaccagaaaagcctgttctactgctgtaaaggtaattgcattcaactgctgataaaaccctggggttagcatctccgtggcagtataacccttggtcgttagtaacaagaataagcgggtatatggatgcagatcatccattgctaaccatgccgccaattgctctggccaggtcgttgtttgttgacgattggtcaagggttgccctttgattgtaaaggttggtaaagttgtaataattcggtgtgaaaataaatagctaaagtagccgtttagatttgacagacatttgttcagtgtcgatgttttgaattggcgttgttcacggagcatggccaagtaagcttgaatatcattctcagttaaatctgctaataattgatccttagcaaaggtttcattgaagtgctgctcatagttgaaaaagtcagccaaggttaattcatattgctcaatcgtactagcttgcttgccagcagtttctaatgaggcgagaaagcttttagcatacggaaatttagcggtcattgatagtaggacatcctttctgggttggaattcttactttaactaaaacataaatttacaacaaaaacaagcgatttgaccgatgctgagagacgcgttctaagcgcgtgttcgtttattagttgaagagtttgtcccttaaataaaccgtaaaatcgatgttagttatcagcaaatcatgagcgtgcatgcaaactagtgataattggatttaggagtctgaaaacatttgaacttttagtgattcagataagttgatccaaattaacgaaaaatgctcggttgaaattcaatcgactaattttagtgttgatgtttgtgaatcataaaaaataatttaagttaagcggacgccttgaaaaattctgaacagttagagccagcaaaatgattgcgacaaaatgacaatctgagaactgaatcaccagaaagctaacttaaaatcaaaaaattaccacaggggacctaaatcaggtcgtgggggagcaattttgtttttgattctactttgtataatatatattatgtaaactagaaaatgtaaaaaaagccccctagctagatttacccataatccacacataagccatcataatcacaacaaaccgcttttatcgcgtgaattgtcatcaagtttactgctagcacagcgataatttttgagtggcaaattaatttatggcacatttttataaaatctactgaactcactgaatcatattgatgtgacttaccgtgaatatatgattatgattcataaaatagcttttgactgtgttaatgatgttattgctcataactgttagtcaatcgactgaattgctgtgcaccttgggtttaaaactggcttttagaacgtaattgtttatcaaaccgatttattgaatcgatggtttgctaacgacagccttattttttcaaaagacatgatttgccatggaccggaaacgccaaaaaccgtatcatgacagtgttcaatcacgcgcttaactgaatcatcagccacgttcaaaaatgttaaagatgtgtaatttagaccagtctgtaatactaatttatcttgtcgacaaccacatcagtctaccgtaatttatattagaggccgcgggctgaacaccataaatgtgagtggcatccttgagtacctgcggttgcatgaagcccaggtaattagcggcaactagcctagctttcaactgttttttggcgattattagtcagaattgtggcttgacaacttgttaattttcagaccattagtcctaaaattaagcgtatttattaaagctgattgtgccattcaatttagtgtcaacaattattgcagactacgaacagtaattcgccatggcctcatatgtttgttggacatgtgctagatcaaaagtttggtgaataatttaccggggtgatgggttctttcaataccacggctaataaaattgtgtaatttgcagcaagttgtcacgaacgcaatgtcatcacgcgaaccgatattacgcccaaatgggtcgttggggttcatttcaaccttttgtgacaacccctacccggccaaaaatagcacccggtcgccctactcttaagcctattccatttcaacgcattctaaaaccgcttcaacaccagttttatcggatcaattgggcaattcaatggttttgacgacaatatccattgcaacacacgttttggctgaagcctggcggattgacatgacggctcatagcaatgattttgctagcccgcgtaattacgaaccaccccccgcactaacagcgtcatccatcgcccatagtactgactgtcgccctgcttaagttgcacggtcgccctagcttgaaacccgttgccatgacatgttggcgaagagcaatcaatcatttagtggtcatcaccgggctgtcctggcagcgcccaatcggcattagtaaatggggattacgggccattaaagtcaattgatccgtggtatttgctaacgatactggcagtgccagctattaactatgaccgtagccacaataatttgatggtacaaattagacgatctgtccccttttaaacattataaaaagattattactgaagtaacagtcactactgtcagtaataatcttttttatatcatcagtttaattttcattcagtgagcttcgaacgctaacgattcatttgggtattgatcttgaaatggccactgccactcaactctgcttgatttgacgccgccagagcttggcctccgcgatcccgcaagtcatcaacataaggattggtaagtacaagataatatgatagcggccctgtacttctaatggtaaagcacttaaggtgaaaccgtctaacaaaagcgatgccattagcaaatagtggttaagatagtgttgatgccatagcagtcccagccccattaaaacactgaataacgcaatcaccagcattgcctgccaataaaccgtcgcacttgtaatcaatataggggctaaataaaaccagtggcggttaagcaaaccgggatgatggcttaagttatataagctccaatcatagccataatcctcacgaataaagccctgcattttttcattaacaaatgacccgaactgtggcttgatttgtttgagattagtctgcaaagtcctcgccatcgttcgtgtgattcgcggataggcttgcgtcaacgtgggcgccacccgtaattcgtggctgacggtagcttgtagtgccgggctataggtcccgtgacttttaacatctgtccccgtagccaggctgtataaagtttcaacttgggctggcgcaaccttaaagccatataaccagctgtcgagattagtcgctgtgaacatgagccctaacacgaccgcactgtatatgaggagctgacgtacttgaacgcggtaaaggtggtgagacttaagcaggacacacaaactcatcaaacccagtgcaattagccagacgcccatgattggcctcagcatattggccacgacagtcatcacgatcgctaacgctaggtatagtcgtcgatccgtgattgtggtcgtcgtgagtggaactaatgcccgcgtcagcgcatacatcatgagtaggacgctggtgaaaaagaacggttcaccaccatttaagagcgtgccgtacagccaataagctggaatccagtaaaaaatgagggcagccatgatgcctaattgtcgtgagagccaccgtgcgactagccagtaaattaagaccatatcgactaaagtacacccaatattgattagttggctgacaaaaaagttggccccgccaaaagccgcgactaaactgtagccgttcgcgatatttaaagcgtgcggaaaaacgacgtaattgccaacgataccatggtgtaacagttgggtccaggtgaatccttgggcactaaacgcggctagtgtatggtaattccagaaatctgaggtcgggtcgatctttaaccctgcaactagtggaaattttaagatagttaaccccatcagtgctgcaactaaccagctagtttggtggcggctcaaccaccagctgccaaggccaatcgtggcaccaatgaacaatacgaataaaccagcgcctatccaagcactgattgcgaggtgtaatttcaggttgacttgccagttggcgacaatcatccacccgagtaaggcagctgcaatcgtgagaacggtaatttgaaatatcttatagcaccacttcatcggcatgcaccttcatctcaatatgagcgttttaagccagtatttggatattttgcaacgcgggtcgtaacaccatggtgcgttttggcccaccccgtttgaccacgtaactgtcggtaaatggcgacgtatggcgtcaggctaatgatcaataggaatgcttgaaaggctaaactctgcttgagagcatctaagaagccaacgggttgtttcacgacggcacagttgcgttgatacagtgctgctaataccaagcaagccgaaaaagcaatcaccagtaatgtcccgatagccaagtgatgccacccaacttgccaatgttgtaggctacggctcacaagcacgactaacgtgattagactggtcagtggcacgatacaaccactgataggcatcaaaatccaaaaggtcgtgtccaatttttgaaaatggttcagacgtcccgaacgccaaagtgctggtagataacgcatgcattgaacggcaccctgacaccagcgtacccgttgacgaaaaaatgggcgtagttgttcaacggcctcttgctggacaaccaaggtatgatcaaaggccgttcgcgtaccacctagcagccaggtccgcaaagtgaattcgagatcttcaagtaagctattcccccacggattctgtaacgctaaatctagccggacgaactgaccattacctgacgcaattccctgaccaaggcgattgcgtaactgttgggtagcattattaacccccatgaattcaaaattctgcatcttagtcagccagttgggctgattgtagatattcacgctcgtttgaatcatggccaactgtggttcttgttcaaagtgcgccagtacccgcgtcaaatcagcagtattcatgaatgcgtccgcatctaggacccccacgatcgtccgttgcggatcagattttagcgctaacgtcttatgaatatactggacggcagtgttgaggacggcccccttacctgcacgctggttgcccgtgcggtgtaggatttgtaagaagcgcgacgatgactgagttagcaacaacagactatgatctgtcgaatcgtcatcgacggcaatgatttgggcgtgaacggttggtggtaactgttcgagagattcggtcaattgcgtaatcgttcgcgagataacgtgctcttcattgagcaccggaataaccaaaaacaattcataaggtgtgggccccttttcatagttttgaataggttcccgatagtgattgatcagcaataagttaataataaaatacaagtaaaaaacaactgaaatcataattgcaactctgattattatcatcataactcccccatcgaaacttattaagaaggtattatacgcatacttttttaaaatgcctattatttatgttatgaaaacatagtgaacgaatcatgcctattctttacgtctttttcacgagaaatttacacttattcggtagttagtgccgtacataaattggtaggatagtattattaactaataaggacggcggagattgatgaaaaaagcaacttggggattactcgcattattgattggacaaccgatcgtcatttacaccgcgcaacgggccctattaacgacgattccgagtcgctatggtctgctgggaacaatcgcttatacgagtgatccgcaccattatttggcgatgcttgagagtgcgcttattccggccttattaatcgcgcttaagccgctaaatcggtatgcggcaccctatacttggtcaacgattttgaaaaggacgctcggctggtggctatttggaatgaattggtttattctgatcagcctgtttgttcaagctagctggctaagctggagtatctttctttggtcactcggtggcgccatggtcctgctcgctaaattattaggtgtcctcagtcagtgagttaatctgaaacgacaaaaagatactgggtagtcagcaacatacccagtatctttaaattagttagttggtttaataactagtcatggtgtagtagtggtgtcaacatatcaatgatccccactgaagcacttggaaaggcaaaaatcttctgacttaacgttgtggcggagacgtgatcagcaataatcatggtcagtaagttgatcaggtctggtgcgccattaccatagattgaggcaccgacgaggtaattctcttggtcaaagactaattgtaaatcagcgtcgacctcgttttgatactgaaaggctaacagtttaccatatggcagcgcttgaacgtgaaagtgttcagtatcatgctgggcagcctcgacactgacaccgacttgggcgattcttggtagcgtaaagacgaccgctggaatgaccggataatcaatggcggcagtgctaccaagcagttggccggcaatgtagttagattcaaaggtcgcggtcggggttagcttcggcaaagtcttactaatgacatcaccactggcgtaaatgtttggaatgcttgtccgcaaatggtcgtcgacgataatgccgtgccggtcggtcttaatgccaactttcgttagtcctaagtgttcgatgtttggaatccgaccagtggccgcaatgatatcatcactctcaatcttcaggccgctggcagtggttgccattaaccctgtggccgttttagtcacttggctaagcgcttcgtcaaagtggaagtgcaccccggctgcctgtagatgtgtgatcatctttttaacgtgttctgaataaaatgcgggtagtgctcgatcggcaaactcaataatatgcacttctgaccctagtaacacggccatgttggcaaattccagcgagatgattccagcaccaattaaggtcaaccgtttaggcatggttggtaggtcaagaaaatcacgactgtcatgcatcaggtccgcacccgggatagccagcttggctggtcgttgtccggtcccgatgacgatggtatccgctgtatacgtgctgtctgctacttgaacagtgtgggtatcagtcagctcaccatgaccggtaataattgtaatccccaattgtttgaagacggccgtcatttgtaccgataaaggttgaatgacttgttgcttataggccatcaactgtgaccaatcgatggtgggcgttgtgttgacgccaatcccttgatattgtttgagttgttcagtcagctcgaagggaccgtctaacagaatcttagcatcacagccaaagttagtgcacgtcccggcgatggtatcttcttcaatgattgctaccttatgttgcgcatgtgctagggccactgccgcatgccacgttgcgtgcccgctaccgataaaaattgtgtcataatctgccattagagattcctcctaaaattatatttcagtcgcacgcgattgaaatggtcaataaaaaggcccgtttaggccaaatcctgtgataatgcggtaataatcttctggttcagggccagtgcttgttgatattcatcgacagtcaggtggtagcgactgatacaagttgcaatcgcggcttcgattggtgcttgttgttgcttaccctgcgtcgtgagatgaatgagtaactggcgccgatctgttgccggtcgctcgcgctgcaaccaccctgcgtcttccatgcgtcgcaaaagcggtgtcaaggtgttgctgcttaagcgcagaacctgacctaactcgtgtaatgactggtcgtcgtgttcccacaatgccattagtacgagatactgtgcgtaagtcagtttgaatggtgttaacgcttcgacataaaatttgttaaataaccgattggcattgtatatgctaaaacaaagttgattagcaaggtcaatttctggtgtcatgcggatgctcctttcaatcgcgtgcgattgattatcagtataagccccttgcccgtaaaaaacaaggggtaaataaatttgtaatctgctggtcgccacagacagcgactaattctaaacttgtaaaagcagttcactcaaaagcatttactgcccttagtcttgggtcagtgacttgatcatgagcaaatcggtttggcgatcgtcccccatcacaaaatcgtgagcactgaattgttcaaagccccacttcgcatagaagcccttcgcgggttcgttatgctcccaaacaccaagccagatcttctgcttatgatcagctttagcaatttgaatcgcttgttgcataaattgattaccgagcccttggtgttggaaagcttttcggatatagattcgttcaacttctaaagtgtctggacccattgcttctgattgtgccgcaccggtgtttaatttcaagtatcctaatgattcaccggctcgttcaacaaaataaaattgtgattcgggttccgctaattcatgggttaacttgggcaagttatatgcatcttgtaagtatgcggccatattttcagaggtgttttgtgcaccaaacgtgtccttaaaggtttcaatactgatttgttgtagtttgttcacgtcagcagtggtgagccgccgtgtcgtaatttgtgacatgatcaattcctcctatagattcctagcaaaaacagtcggtcacacaatcaacgctgtaaatgcgctgatgatgtgactgactgctttatcttaacatattatttagcctttttaccccaatcagggataatcttaccatcttcactaatggcgagaccgtcgttattttctaactcagctgcgttcggatcctcgaagtcattttcaagtgcatccacgaaacgagctgtagacttaccatctagatcatcaaagaagaagttcacaaagccgtccaatttagcttggtcaacttgtggatgttgcaactggctgatcaactcacccgtgttttccgctaaactaccaggaataaaatcaaagtagttgaagtaaaagctccgggattgcatgtaatccgctaagtctggcgcaaagaaaatcattggccggttcagtagtgcgtattcgaaacaaactgatgagtagtcagtgattaattggtcagcaacgagtaataaatcgttgatctcacgataatcagaaacatcgtaatagaagtccgaatattcatatggtaacgttggtttgttttgcacaaacggatgaatcttcagtaaaaagacgtaatcttcgtgtaatgcttcgtagattgctctaaaattcaacatttcaaatggatagtatgctgattgctggccattgccacggaacgttggggcaaagagaatgacttttttgcccttgatgaatggcaggtcatgcgctagtcgctctcgaatcgcctgtttcttaggttcatcgaaaaagatatccgtccgtggtatccccagcggctgaatcttatctggagcaatcccaaacccttccgcgtacttatccgcgatgttatgcgaagaaaccaaggctttggtgtaattgcgatgatttaacgattgaaccttaggaccaccaggcatccccaaccggctgtaaccaaatgttttaaaggcaccgaccgcatgccatacctgaatcaaatccgcattttcccggatatgcaatgggtaaactagtgggtaaaagtcatctaaaatcacatagcgactagtagccaacgctttagccaacgttcgaacctctttccaggattttttggttttaatacttggcttcaaatagaatgaaatcttaaaatcagtattgcgacgttttaattcctggtagataaactcgaaattaccggagattgtcacccgactatcggaaacaaatgaaatttgtttcttatgaatcggttgaaggcagtaccaccgataccagagttttagcgcccggcgtttaatggcacgcatcgctacactatctaacccgacatcttcagtaaactcattttcaagcgggttgacatcactcagtttatatgaagtgacctttaaggcttgggcggctaaattataccgaaaaattagactgtatgacttattgcttttcgctgaatagcttgtcattttagtcgtataatttaagtcttgctgtgtttccaccacttgaccaatggaggttcgtctgataatccaaccattacctagatactgttttaattgtatcttgatttcataagtgcctggcgttagcggtttaccctcactgagtgtcgaaaagttgatgtcaccatgatacccggcatatggaaaatcagcgttttgaccacgaacgttgatcaacggaatttctaattcttcattcgtcttgctagtcaaaattaagcttttaataattcgttcagtatcttgttcgggatacttttcaaaccacgccattccctcaatcactaagtaagaactgttgaattccagcttagtcacttgacgtttgatcaatgattcggcatctttctcaattcgcaatgtatttagaaaatcaacgtcttccttggtcgtttgtgcgtcctcaaccagttcacgattacgagtatattgcggttgattccgtccgtatacgatgcgacgcgcgattcgttttagtcgttgtatcatctaatgttctccccctgctaatttttcaacaaattgaacgacccgttcggtattatgcccatcttgatgtggaaatgtcttttgctttaattcatgtacataagatagatccatatgatcaacttcctgattaataaaatcgacaactcgcgccgctttgctgaagtgcggtgcttgcaaatattgatagtaatcgacatagaatccggatgtttgcatataatcatcataatcaggcgtatacagaatgattggtcgttcaaaataactaaacgtcaatgataatgacgaataatcggttataaataaatcaatcgttggcatcagcgtcttaacccgctcagcatcttggaagatatgcacgttggatggtagcgtcatcgctgacagttttaagtacggatgcagcgaaatgtacagttcccatggaccggtcagctgctgacaggccgcaatcatgttgttgacatatcccatgacttgctgcttaccctggacaccttgccgataagtcggtgagtatagaatacgacgggcggcgagccgcggttgttgtggttgtcgattaagcaacgagtcgaccattggcgatccagtggcaatgacgtgatcttgattgatagccatggcatctagataagcaggctgatcagactttgcattgatcaagacccaatcataatttgtgtgcggcttcatgacgctctgatcagcattcggtaagctgaggccaaactttttcaatgaaccaatggcatgccataattgtaccacttgattatcatcatgtttgtgaattgcgtaaagtggaaaaaagtaatcatcgatcacaaagacgtcagccctagcaatcacgtatagcgctttaatggaggcgagcaagaagcccacttttccagccagggtgcggtcataatgatagcaaaacacagtaaccggtttaacgttggcagtttttaggccctgctcaagagctgccaaattgtcgtttaattgaccgctgcgcatcgtggcaagtgtgatccgtcccttcttcgggccaaacactttataaaaaaattgatagaataaattaaagctcgtgtgtagtaacacgagctttaccgtctttagacgtcccattccatcacctccttgccccaataattagtaagtgcactatcaaagaagttggtaatgtcttgaatggaactcactttttgaacgtagccaactaaattttgcaaccgttcgcgagtgactggactggaggataaaatatcaacggcacgtttaaaatcttcacggctgctgcgactgacgcctcgtaacgtcaatccttctgcaaggacagaccgggtatcgataccgactgggttttcagagacgcccattagaatggcagttcccatcggttgaatatgctggataatttgttgaatcgctgcttcactgccctggccgccggtacattctaaggcctgactgaccttgacatcggctggaatgtcatcgaccaggtaagttttgtctgcaaatgagaaataatctaacttggattgatgccgaccgaataccagcaactgactgtctggaaaaatttgcttaaccagagtcgctgtaatatagcccaagttaccatcgccccaaataccgataacccgttggtcctcatccatggtactttcaagcttggttaatgcttgaacgccgaccgagaccatctcaatgaatgcggccatgtgtggatcgaagtcgcttggcacggtgattgcgcggtcgcgtcgtaaacaaacatattcttgcataaagccgtcgtagccgcttgaacggaatcttgaagaaggtaaataattttcctgaatgattgaatccttcttaacgggcgtattaggcaccattgcgacgagcgtcccaggcttatactcatttcgaggatcataaacgacctcacccacggcctcatggatcagcgccattggtagcttagcacgtaatgcggcttgggagcgttggccaaagaaatagcgcgtgtcagcatggcagatcgataagaactttggccgcacgatcaaatcatcggcgtctacctcttcggcgaccgtttcaacttcaaattgacggggacttactaagcgataaacttgatttaacatcttatgacctcttttctactaatgctgatgcaacgcgtaagtcaaacggcgttgtgattttaaaattataattttcaccacgtactaaactaaccttttgaccagccagcgagcagattttgcatgaatcagacagtgatgccttttgttcggagctgagtgcgttatatgagtcgatcaatgttttgatgtgaaaactttgaggggtttgaccctgatacatttcggaacgaaccggaatatcggtcacctgatcattagcaccgcggacgattgtatcgattgctgggacgacagtatcgactgctttattttctaaaacggcgacgatattgtcgttaatgatacgttgtgtgatgaacggccgaactgcgtcatgggtaacaacaacatcatcgtcttgaatcccgtaatgatcttggatatagttgattccactcattagtgtttcgttacggtcggccccaccaacgacaacgtgaacgcgctcatcggtgatgtactttttaatgatatcttcagtatggctgacccaatcggctggacagacgaccaaaatggcatcaaagcgactttcaagtgtaaatttttcgatggtatggattaagattggtttgtcggcaagcagcaagaattgctttggcatcggaacattgcccatacgagttcctttaccgccggctaatatttgtgcataaatcatatctacatgaccccattcattatttaaattatgtggataatgataaataagaattttatgttttttgtgaataaatatgaaagaagtgtgacgttcctggtaagaattgtttttttatttatttggttaaagtaagattatacgattggcttaaatatatctacgtatcccggcgctcaatttacaggtaaaagtgcctaaacataccttttaacaccatttatgtgcattaattggtatactaggcctagaaaaactaacgaaatggttgtgattatctttgactcgtctacgaaactctgggttggacttctctgtcgcgacgcttaacttcttggctaacgtcggtattgtcctgccctacgttctaattctctttaagtatcagcagacccacaacgcgaattacttagctgcgatcgtggtcttctacgtggcccgggcggcgagcgtctttgggactaaacacctaaacctcaaggctagtagttatttgctcatttgcctctggctgggtgcgcttggtagcttgttgttcagtttgacggctaacatcgtggccgtgctggctggggccctattcttaggatatacatccgccaacatctggccctattacttgacgatcaagttacacttgtccgcgcagacggattttaagttaaagaaaatttactggttaattttcttagttctcggcattctctttgtgctagattttgcgctgaactggggttaccggcttgcctttatcctactggcgctactatttatcattgcgttgcctgctggccgtttgctgagtcagttttcgctcgcattttacgatcaacatgaaatggcccaagtacgtcccatcaagccgtggcgcgttgtggtttttatcgtcttctttgctgcgattggtttactgacattgcttcgtaaggcgagcctacaaatcgcactaccggccgtattaggaatcatcgtcgtggccattgttctactaaatctagaactagctgctgattggcaagccatgccggctaacaaactacggatcgttgatcggggctttttactgagttttgtcctactgtttaatagtttcttcggtgtctttgtctttggcaaaatggggatgtacctggtcttcgccatctatttgttgggctttgagaccggccggccactatatttattattgggacggcatgacttacatcgtgccaccacgattgcacgcggtggcctgattgtcggccatttgttagttgccacggcccaacccgttttatacgttgccggtttgctcctgatctcgttgtacgtcggttttgaaaacccagccattaatactagcgtttatgccactgaggttgatgatccagatctcgcaattattcataaatatcgcttttccacttatggtggcctgctttgtcaactgtgtttcttcggcctcttagtaattgttagcagttttcgacaattaaacttgctcaatttcttcaatccagcttcaaccgctttgaagaacacttatctagtagggatggtttggcccttaacggcgatttctctgattgttacgctggtcacgctctacggtcagtattatttcaaacgagcacagtcaaacgactaggcaccatctaaggaggctttacgaccatgatttttattgcaagtgctgcaatcatcctgccactgattcttctcgggggcctgaatttatccgcgacccgtggaatgaccattagcgctctggtggtgattattaccggctactttttctggcagattagtccaacggtcctcaccgcctcaattttgcaggcgattcataaagccctccccatcttatggatcttatttggcgccttactcatgctcaactgtttgcgtgccactggtgcaatcgaccggattaaccagggctttcaaagtttgtctgctgacatgcggctacaaaccgttttggtagccttcctatttgggggcttgattgaaggtgtctcgggcttcgggaccccagcgatggtcactgcaccattactaattgcactcggcttttcacccatggcggccgttatcttggccttagtggctgactcgacccccgcagcgttcggcgccgttggaacaccattgaccgtgggactgagtaatgtgaccgaaaaagcatccgtcttgaacttgattggcctgcgcatcacgcaactcgatttattcgttggtgcgctaatgccagcggtgctcattttaattctcatcatgtggtttggccctaaggcacaccgcttgaaaagctggctttccgtcttaccttgggcgttagtgatcggtttcgtttacagtctactggcactcctcagtgcttggctagtgggttatgaatttgtttcaatcatcgcaccgctgggaacgctggttattgccatcatcacgatccgattgcactggttgttaccaaagtcgagccagttgacgccatggcggacgaacgggatggcagcccagacgcctgcgcctagtccgatgaacctgatgaccgcttggtttccttacctgttggtcgttgtgctattactcgctagccgggtcgtgacaccaatcaaacaggttttgacccgttatgctaacttatcgtggtcccacattctaggttatagtcaaatcaactctgattgggaactcctctattcgccagggacaatcttggcggtagcggccatcattgggttactagtacaagcccgttcattaaagcccttactaccaactgcccattcggtcatccgttcgatgggcaacaccgcaattgccctcggtgttaccctgatcatggttcaagtcttcactaattctggcttgaatcaggccaacctacccagcatgccaatgtatatcgccaagtttatcgcgacctatctagctggtgtttgggtcatcatggcaccattcctaggccaattaggggcgttcgtaactggtagtaccacggtctcgacgctgacttttgcgcaaattcaagctgatattgcggccaatgcgagtttgaagcccacgattatcttggcagcccagcttgtcggtgcggcagccggcaacatggtctgtgtccataatatcgttgctgtcagctcagtcgttggcctgagtggtcaagaaggcgccatcttacgtaaaacactactaccaggtctgggttacgccctgttaattggcgttgccgggtggctactattacgtctcttagcttaactgaatgcgtataaaggcactaatcaccttaactgcggctgattagtgcctttatttcatgaatgaattagactaaaataggattataattttcaacgcaaaggaggcaccgacatgcaagtgcgcttagtgccgaacttacaactcggtgaacggattattgggccgacccccgaccccgaggccaatcgcgcgctttatcaacgctatgcgaagcgattacaggcgcggctaggtatcggctttcaagtctacctagatatgagtgacggttatgatttactgcatgcgcgtgattacgacaccgatacttgttgggtggttgcagcggctgtttaccaagcattaactgattctgccgtgatcacccaccaccgtatcatctcgctgagtgaccaagcacttatcttaaaagcgacgcagcccatcgaacaacaactgcgccaatctccgactgatcaatagtcgcgattcaccagctagcagtcgaatgagatgaaaataacacctaaccaacaaaagtagcagtgtactagccatctctggctagtacgttgctacttttatttgtcggctcactgcttaacttaacgagcgtagaaactagttattgattattgcatactggcagccattttgatagccgttgccatctcttgagccttgacttgataaaccactttaccagcttgccattggataacttggtctagcggtccagagcctgatgagatcgcgtcaaaagtgatggcgccgaccgactgtggtgctggtaagtagacctgctcgaaagtagcgacggcctgtttagctaacgcgacgcccgcatcttcgtgcatcatgttcgcatgcacggtcaacgaccagcggccctcattccacatgatatatcgttgaccagcacccgcgtcgatatgcgcggtgatttgatgaccgagatcgacggttggcagccctgctgtggatttattatcacgataacccacctgctgggccgcggcattagttgtcgcataggtcgtcttagtgacagtcgcataagccgtttcatccaccacggccgtcgcgttgaatggctgggcctgctgtcccacactataatggatggtgtaattggctgtgtcacctgaatagcgcatgttcaacttcgaactgccactggttaacccatcgacttgtggaacgagcgcctgctttcccagcgtcttagtcaattgttgattcaatgctgccagccgggtcgtagccgtgggctgggtgaccgacttgttagcagcgctggcccgctcacgtgctgttttagacgagcgcgtggctgcggtttgaggccgactactagtactactggtagccttagtcttcttttgggtgctgctgaccgttgccttggcactcgtggtcgtctgactagtcttggaatcctggtgtgttggtgatgaacagccgaccaacaagacggcaagtggtaatacgagcaagttgcgataattcatactgttcccctccccaataatcatgtcacggctgatacgtggtcgtcagcaacgtccatgatgtttgacttaattatagaatagaatgcactattaggggtgattattgcaccttacaaaaatcgccggccattagctggtaaactaattgggtttaccaagactgatgaccggtgattacaattatcgtttttaaacggtgcgatgcatacttcgttcgatgactaataaaatgacgaaccaaacgactgaaccgatgactgcccaacggttgacttgatcaaagcacaagacgaccgtcaccgcgataaagaaggccaaggtcgcgatgttggaaacagggaacagtggcagtttaaacggattatgcgtactgtcagtggttcgtttgtaaacgtaatggcacaccaacaaggcacaccaaacaatgatgaagttggtcgttgccacgttagagatcaacgtgaagacggtacttggaatcacgtaattcaacgccacgatcaccagtaagatcaatgatgagaataacaatgagcgggcgggaacgttgtaacgattgacctttcccatccatttcggcgcgttgtcaccgtgcgcaagtgtaaatagagttcgactcgtactgaagatggcactattacaagccgagagcgccgcggtcagaaccacgaagttgataatgctggccgcggctttgatcccaacgtcgctgaaaacttgcacaaagggtgactgactggtcgtgatctgatcccaaggataaattgccatgatcacgaataaagcgcccacgtagaagaatgagattcgaatgggtaagctattgatggcccgtggtaattctttttctgggttttcggcttccccagctgtaattccgaccatttcgatgcccgtaaacgcaaagataacgagcgaaaacgacatcaagaagccctggacgcctgttgggaagaagcccccgtgactgaccaaatttgtcaccgagaccgtttgcccaccgacatgggccgatgaaccaatcaagatagcccccgtcacgatcaaagcaatgatagccaccactttaatcatcgaaaaccaatattctagttcgccaaacgcactgacggagagcatattgaatactaataaaatcaaaataattattaagggtgtcacccactgcgggatccacggaaaccagtaacgaatgtagataccactagcagtcaagtcagccatagctaaactgatccagcagagccaataggtccacccaatggcaaactcgaaacgtttacctaaatatcgattaatgaattctagaaacgaatgtaaacgcgtatccgacaataatagctcgcccagtgctcgcatcatcaagtaacagaagaaaccgccaatggcataagccaacaagatcgacggccccgcctgtttgatcgctgaaccggagcctaaaaagagcccggttccaatcgcgccaccaagcgcaatcatctgcacgtgacggcgttttagtttacgggcaagttgctgattttccatatgacctcaactttcctttaatccaatttgataataattttcataaaaatacagattttttcacgtccattcattttatgataaaataatccgccgtgcaacttttgccaccgaaggcaaccgtaaaaaacgggttttaattgccatgcaggattttttctggtatctttaattactttgattattactggaataccagtcattagagctaaaggagtttacttatgccaactaaaacaactgatactttctggaaacgattcttcaagggcgtcgtcatcgccctcggttttattttaccgggcgtctcaggtggggttctcgccgccattctcggtatttacgaacgactgttgggctttatggcccacttccgtcgtaactttaaacgggacttctggtactttgtccccgtcggattaggaggcatcgtcgggattgccctgctttccgccccgctggaatacttacttgcacacgctcaggtgatcgttctctgggggttcgcaggggccatcatcgggaccttaccagccctgatgaaaactgcaactagtcgggcgccacgtgactggctcgacggagtttggttcttcgggaccttcattattagtgccggcctactttactttatgagtgagctgtttgggaccttgcccgctaactttggtggtttcatcgttgcgggagcgctgattgccttgggcgtcttagtgccgggactgagtccttccaacttgctacttattttaggccttttcacacccatgctgacgggctttaaaagactagatatcgtaggcgtctacttaccgatcgccatcggtggcatcctggcgatggcgttgttctcgaagttgatggatcacctattagtgaagtttcattcccgagtctaccatttcatattaggtattgttctggctagtaccatgctgatattgattccgaatccatatgcggctgagagtatctcatatgcgcatgccacactcagtacctacctattcagcgccatagctcttgctgtgggaatcgcgctgggttactggatgagtgctttagaaagtaaatataaatagtgccactgaccgttggcaatcttgacgaatgccgttgtgcggtcacggttaaccaaaaaactgagcgtcggaatgtgaaaattccaggcgctcagttttttttgttaactactcaatcagccaccttaactttgattgcgacgtcgccgcggctgcaatcgtcgcaattcgttgacttgtgcttgaatctcacctaacatttgtgtttgcattttctggatttcaagcatgtttggttcatcttgttgaattaaatgatcgactttcgagtgcaggacccggatctcctcttcagacatcgagttcactttaaaatcattggccgcttgtagccgatcatactcagctgcccgattctgactcatcatgatcaatggtgcctggattgctgcgaccatgcttaaaaataaatttaataaaataaagggataagggtcaaaatgatggctaaaaattggtaagacgttgagcaacatccacacgagcatcaccacgacaaacgaaatgataaacgcccagctccccccgaaccgtgcgaccccatccgcgacccgttgaccaaatgtcaatgaactttccagctcgctattaacatcgacgacccgatacgtgtggttagcgagaatcttagataattgcgcattgaccttatcattttgttgataatcgttctcgatcatcgcatccatctttgctaagcgataatgtacgagatgctcactacaaatgaaactgctattatgggcctgcggaaaatcttttaaaatcatttgccgcaaactagtttccaattcttctaatcgcataccgtccacaacttggtaacgttgttgatcgacaatgcacactgctgttttcgccattagacacacacctttctctgatcccggcgtgagaattacgtgaacaatgcggcccccttgattagcaaccggaacctaacatcgcaaaaccacacctcacaccatctatttaattatacaaatttaaggcgcatctgcccagttaaagaccaccaatcaaaaagcgattattcgccggcctgaagtgacgagtttcctcgtattcagctcattgaataatcgctgcgttcagacggagagttcgtccatcaacatcatggtctgatactgaccatcgtctaagactgccaccgtctcgggaaactcccgttggtaattgactggtaaatcgaattccatgatggcatcgtgctgcgcatcaaaagccacggtgacttgcccattacgtgcgatcagggcaaattgcaggacccgtggcaggcgaacgaccccctttagattttgatcaataatatcccaaatgccatcaatcaccgcgctcggtagcttggcggctaaccctagcgttgcaaaccgttcttcatcttgatcaaacatgctaatcacctcattactcaattcggcttagttatcacgaacaatcactgcgacctctttttcaatccggataaataagccttgtgaatcctgtcgaaaatcattttctaacgtggcagacagcggtttaatgcggccaacgacggtgccagttgtcccatagagttcgatagtctgaccatctgcagcccacttaactgtccagtaactaccttctaaggcctcatcgacgaagtactgagttcccgccagcacagcttcattaatcacgctactttcatccgcagtcattcccgcgtctaattcccacttaagtttttgattaacttccaacatgtctcctggaatcaaattttgcatgattattcctccacttttgttcatttacttaacatcataccacaatcacaactaatatcaggcattcaaacttatcggtaccagttgtcagtcagaaattgatatggtattgttatgataagaaaatgagattattagaaagtggtgaatgacgtgttggctaaatttttagcttggattaaccttaagcgcacaatttttgcagttatggttatgtcaggggcgcagtctgcgctttttccaagttgaatgaccactagccattgcgaagtcacgagcagctgacgacaatgggtcgtctttttttgtccgctcgtggccgctaaaggagtccaacatgttatcaccacttacccgtcgtaacctaaccctcagttatggttatgcggcctgtgctttttttggtatcaacaccctctgggtgatctttttacagcaacaaggcctatcactcgttgagatagggctatgcgaaagtgtttttcatctgactagttttctctcggaagttccctccggcgttatcgccgaccgctttggttatcggcctgtcctgatcattagccgcctgatggctatcggacacgccctcatcatgttgacggctcacagtctcggctggttgctcctagcattcatcctacaagcctgggcgtataatctccagtctggtacgattgaagcggcacaatatgacagtctcgtcaatactcaggccacgcaacattatccacgcgtcacgacgattctcaacacgacaatcgaagtggccgatacgttgggtgtcgtgttggctggctggttaatgccccagcatctttcagtgacgtactgggtctatttagcggcagcgctcattgccattctggcaatcagtgggctgcacgttccccagcgccagttgaccaagactcattcaacacaaccgtcgttacgaacgatccttcgtgctgccgcgcatctgttagtgacccaacgtcgtttacggcttttaatgatctttgacgcgctcttttcggcactcggaacaacttattactattactttcaaacagtgatgactgctcagcactttagtgggagactaatcacgacgatcctcattgcgagtatggccctcaatattgtggcgatccaactgacaccttggctacagcgacatcaaacccaacatcagttactttacgggctctgcctaagcatgattatggccctacttagcgcatttagtcacgccatcggtctactggtcctcatctatttagtcatcaatagtttgatggcactgattgagccactgttttccaactactacaatcagctgattccaaacgggcaacgggccaccctactgagcgttgccagcatggtctttagtttagcggtgatcagcgcttttcctctgattggctggttaattcaacgggtggggtttgccgttactttcggtagctgtggcctgctgacattgatcgccttgctgagtctttacggctatgcccggcgaagggccgtccagcattgaaaaccataactaatcactgacattactgctgagagatgttcccccacgacttgaccggttgtttttgaccaccccgcaaccagatactaatcgcaattgtgtcaccattaatcatgcacgtgaacggtaaagtgaaggcccccgagaatcgaaaggattcctgggggccttttccgtcgtttggggctgttcggcctattagctagtttgagtgagccagattcgatcgttcaaactgttgccgaatttcctcagcgatggcgcgcattcgctttggcgtatctgcttgtgccagccgatagccgatatagtatggtgagacattaaatagtgggaccactttggcaacaatctggtcatcccgcggatagaaaaataggttataactatcacactgcccatgaaaatacgtatttagcgtatactggacgacctgttgcacagcatcggctaacggtgcaatcgcggtagctggagcagcaacgttgatttcgacaaatcccatgataggccgatcagaaacagtcacttggacctgatcgaccgccaacactgaatacccagtcaaattggctgctgtcacgttagcgtaaccatcggcggccattaaaccaacgatttgcatgtgtggatgccgtaaacttccacccgagtgtgggccaaaatttttatagcacaacaccgatttgaaccgaccactcgcaattgtggcttgccagtgcttcagagcaaacgtgaagacagcgcggttttgtgcggatgagtaagtagcaatatcgccatcatggcgggccgcctcgatcacgatcgtttgccaggtagcttgcaaggtcggaaatttattcaatagccagatacgatctgcatcttgcgcgataatatcagtcaactggcccggatcgcaaaaaggacaggcattgtgcgggtgccggatattttctggcttatccttcgcaatggccgtatcaaagattagtggctggtttggcaaggtttctcaacttctttcatgaaataagaaaacgggtccgaaacaccaattaggtgccgacccgtttgccttttatacgcattagttcattggttccggtgtatcagcgcccggaccaaactggacatccgccatcgtgatccaaacaacaaattccgttgatgctaaccgccagtactgcggatccgacgccggcgggagtgattgttcaaagagcgcaatagccaacgcgttcgccgcattgtccgcagcaacttggacactcgccccaaaggtctgggcggcaggaacgtctggaaaacggacatcccagtaggtgccttcatcacgaaaaatggctggatacttaacttccacataattgtgattcaattttatcactcacttcttacaatcattttaaggctattataccgaaaacggtcgcaaaagcccagctcaaacatcatgattgcaattaaaattaatcagcttttgacacgtggtacgagccattactatccgtcgtgaccttatagttcccattgatcgagttttcaccatagtccttcgcgtcatctaaattatcgtatgtcgagccggagtgactgctactgctgctcttctcagtactcgttgatgacgtctcactcttagatgagctgctagctgttgaagtactgtgagaggtggcactactggtggtcgtttgatgactggccgtcgtgctatgcgaactagctgtcgtattgccagcggtcgtattagtggcagttgaactgctatacgcacccgtcgtttctgtcccatctgtgctagtgtcggcatccgtacttgcagccgtcgtttcgctagtactttcactacttgagcttgaatgcttcttctttttcttcgatgagctagatgatttcttcgaagatgattttttgcgcgccttgctgctacttgaggaactcgtggtttcgactaagtcttggttgctagctgctttgacaaagtaaacgactgttccaccgagcgcaatcacgattaaagccaatagccataacgaaacgtgatgttttttttgcggtgacttaggtgcttgcggtttctttggatcgttcggttccttaggtgcatgggatccctgtgaactcgccttacgtccccgcttgccacccgtagcctctcgcgcttttaagcgtgacatgcgcgtctgtttttgttcaggcattaactatcgcacttcctttcttgcttccgccagtttaccatattttggcgggcttgtcttaatgcttaataaaagaaacaatattatttgtgtcgatttttaatatcgacgctcattaattaattgcttgtaaattatcataatagttggcaagtacaccataaatatatggtaccaaccataactggccgattccagccgttaagatactgagaagttcccagcccaaaaagcttaaatgcaacacgaataactgccacttgtgcccgtgcatcaactgacggctacgggtgaccgcatcacgatagcgtggccgtgcttgaccagcaggtgttgcagctaacaagtccttatacgcataaaaagtctgtgaataagcgtacgccttaataatacccggaaccaccaatagcaggctccataggaagataagcacagttttataaataatcagaccgaccagtgcccatccataacgtttcgtgaacccgaccgttgagtcactgaccggatggatctggcgttctggttgtcggacccaatccaacatcgcataactcgtcccaatccgaaagatttgaacgaccagccagacaccaacttgaaccagtaaaaacccagctattacagctaaaatcaacgatatatcagaaccagtcagggtccccaactgcttaaaagccgtgtcgtcagtcgtggaactgcccgacgacacgcgatctgaataattggccatcaccccgaaaatcgttaataagctaataataatacataataagatggcatctttccaacgccccttaaagagttgcttaatttcggttttaagttcggccctcgttttttgaatcattgcgccactcctccactacttgtttaatttagtccattttccgttttttgtccccgttagtcaacggcaaaaccctaaaaaagcgctggcaaaatgccaacgctacgagttgaatcataataattgcttatgcataatcacaacgggggccccatcttcatcatacgggccggccgtaactcgataaccacacagttcgtaaaagcgctgggcagtgagttcaccatgaatctcgccatgagtaaaaccacgttgcgtggcccactcctcagccgctgtcaataattgacgaccccaaccatgaccgcgataggccttccgagtgcagactcgaccaaatcgcatcacgtggtcagcttgtggttctaagcgtaacgttgtaattggtaaatcaggctgtaaatatagaacagcatattcacgctgatctgtatccttgacgtcaaattcaacgtcagcactgattccacgctcttcaacaaatacagcctgacgtaacgcgtaggccgctgcccgattggctggtgatgctgaaaaaataattttcattttagtaggccttatcaatgtccttcaaccaggctaacgctaatgacttgtcacctaaatgggccccaatcactggaccaaagtacgtgatatcgatcggcatgtctggataaatttgttgtaacttttgtttccaatcttcagcggcagccaaattattcccctgaacgataattgctcgcagcggatagtcgacttttgactgtgcttcagcaaagaggtgctcaactcgcgctaaagctttcttagttgaacgaactttctcaaaggcgacgatttcatggctctgatcatcaaaagtcaacagtggcttaatccgtaacacgcttccaatgaaggctgacgcattcgataaccgaccaccccggaccagattttgcaaatcatccacgataaagtattcgcccatcgaggcccgcagatcatctaggcgtgccaggatttcttcaacactgtgaccagctttagccatccgcgcggcttcaattgccaaatagcccatcagacggaccgtgatctgggagtcatacggataaagtttgatattatcgaccatatctcgcatgttcatcaagctattataaaaaccggaaatcgtgctagcaagatgaatactgatgactgcatcataaccttgttcacccaagcggttatagaatgccaccatttcccccacgggtggttgggacgtacttgggaacgacttaaatgatttcatatttgcgtaaaagtcggccgttttaatgtcgacaccttcttgatacacttttccatctataataaccggaatcggcacgacatgaatatcgttgtccgcgacctcttgcggtgtcaaatagctcgtgctgtcagtaacaacagcaatcttcatgacttacacctacttctcatttaaataataacaaatatcatagcataaaactaagttatactctaccttcgaccgtttggaaagtcatggctcgagaattcggctaactgacttgtttaaccgattgagcagaatccggagaaggttttgttcatcttgtggccatttgtcaaaaacttctgcttcaaactgttgataatccgcattaatcttggtcaatgccgctgttcctgccggcgtgaccgtgtaaacgagttggcggcggtcacgaccaatcgcttccttactcaaacgttcttttttgactaggctagccagttgccgacttaatgtagatgtatcaagctgcatggccgtcgccaatttttcttgcgtattggcccccgctgccaactggatcagcagttgccattccgcaacggtgattccttgggccttagtaatttttttcaacatggcagtttgcaacttagcggtttccgctaaggccgttaaacttgacttcatgacagttcattcctctcaacaataattcacatcggtccattgtgacttaatttaccccgcctgatgattaaaaacgtcccaatttttagaatcaaaaagactcaactgagctttgctgacgcaagcacgtttcagcgtaaactggctgatccagtgcgattccatcgtaattagcacgctttaaccatcacttatgcgaatagcagcacacacaatgaatacatttgtattatacaatatagagtgcgtaattacgactactttttatttaaaataccgttaaagtagtttttgcatataacatttttagattcaaagcggtcatccgctaattgcttgtttgacaactagcagcgtcagcgcctaactttatgcgtcaacgcggggcgctaacttgtttttaaccgttcaaaaacggtatactagtacccggttaactgtatttttacagtgataacgaatatcttagaaagcgagtgatcacatgtcctttgatggtttatttacccatgccatggtcaccgaattacgccaaacactagttggcggtcgtatttcaaaaattaatcagccataccaaaacgagttgattctgaccattcgtgccaaccggaagaatcacccagttctactatcggctgacccgacgtacccgcggattcagacaacacaaatcccttacgttaatccggccgtgccgacgaacttcgcaatgatgatgcgtaaatatttacaaggtgccatcgtgaccgatgtgtcgcaggtcgccaacgaccgggttgtgcacctgaccgtgacgacccgtaacgaactcggtgatgccgagacattgacgttgattatcgaaatcatggcgcgacatagtaacgtgattctagttgataatcagactggtaagatcattgacgtcatcaagcatgtcggtgccgatcagaatcgctaccgactacttctaccaggcgcgacctacatcgagccccccaagcaagacaaacaagacccatttacaccgaatactgattttcacaccttagtcacggattaccccaacgaagacgtgttggcaaaacaattgcagcagcattatcagggattcggccgtgatagcgcgcaacagttagctgccgatttacatcagcctggcaatcttgatcaccattatcaagcctttttggcacagtttgatcagcctcagtcgacgttgatcaccttaccaaatcataagaccatgtttgccgcgggaccgtttgaccattttggcaaagccacgcgccagttcgactcattgagcagtctgcttgatttttattatgcagatgcggcccaacgggaacgagttcaacaacaagccggcaatctgattcgggtggtcaaaaataacctgaagaagaatcgtaataagctcaaaaagttggaaaaaaccttagctaacaccaagcaggccgatgagctgcggttaaaaggtgaaatcttaacgacctatctacatgaagtcaaacgtgggatgactgagatcactttaccagactattatcacgataacgcgccgttaaagattcaactatctaatcagctctcgccttcccggaacgcgcagaagtatttttcacgttatcagaagcaaaaaaatgccgttggcttcgttggtgagcagatcagcttgacccaagctgaaattgattatctggacaatatccagacccaaatcgagcttgctagtcccgctgacatcaccgaaattcgtgaagaattgacgcaacaaggctacttaaagcaacacaagactaagaaaaagcaacgcagttcacgtaaaccgagtcaaccccaggaatttactgcgagtgacgggacgccgatctttgtcggtaaaaacaaccggcaaaacgatcagttaacattgaaaacggcccgtaagagtgactattggctgcatacacaaaaaatcccaggctcacacgtcatcattcattcagatgatcctagtgaccaaacgctcacagaagccgcgaatctcgccgcatacttctcaaaagcccgcgattcagcaaccgttccggtcgattacgtccaagttcgccgaattcgcaagcccaatggcgccaaacctggctttgtgatctatgaaggtcagaaaacattgtacgtttctcccaatgctgagcttgttgaacaactgacaccgcacgcgtaaactggttttaagagtacgcagtgatcaatcattaaccaacaaaatcgcgcgtccaagataaaatttctggacgcgcgatttttagtacttactggcagtgcttcaaacggtaacggttcaaacttcccgccgccgaaagaatagcaggcctaacactaagaataaaataatgtatgcaagattgccccaaaacaactggacatccgtgagcttggtaattttactcagcgtcggtaatcccaactgggctgaaaagttgaacatgttgagtgggttccatttgagccacgtatacttccgaatgagtgcgatcatgggaatattaaccattcccagaacaaagtatccgatgattccgaccgcgactgccgcaccagaactcttgaaaagagcagcaattagcagcactagacttagcagtaaccacgtattgagaaattcaccaccaacgcccgccaaccaatcatgccaaaacttggcccgcgtaaagatcgcaaatttatcatttactaagcagactttaagtaagatggcaaacagactgctaccgacatacaacaatagactgtaggttaacagcacgagccacttactaaccaaaacgagtggtcgtgaataacgctgcgttaacacgtgcttgatcgtcccaaattgaaattccatcgtgatcatcgtggccgccgctgctaccataaaaaagacgatgaactgctgcgcttcaaaattagcggcaaacatggttttggcgggaaaaatcgtcggcttgatccgcaccaaaatcgcaaagatcagcgctacggtagccaatatcagtccacaccaaatcgtagacttcttcttaaatagttttgtgagttcttgtcgatataacgccatcatcagtaccactccctaggcgctggttgtcgccagtaattttaaaatcgtactttccaaatcagccgcctcatgccgaacatccctgaccgtcagtccgtgactagtcagaacatgaagcacatctgccacctgatggtccggtgctaagtggactttcacaaccgtgtcggcaactacttgatagccggccgccaccaaaaccgctttcgcctgaccgtcatgatcagttttcacaatgacaaaatgatcggtcgtcgttaacagtgctgtcatcgttgttttctcaataattttaccgtgatcgataatgactaaatcgtctgctagcttttgcaattcactgagaatgtgactagaaatcaaaaacgtgacgcccgcctgtttttgcttcaagataaaatcgcgtaactccttagtaccttgtggatccaaaccattcatcggttcgtccagaacaaccaactgaggctgattcaggaaagccagggcgacacccagcttttgtttcatccccaacgaatagtgacgcgctttttgatggatatagtccgtcatatttagtgcagacaccactgctgccaatcgtgcttgagcatcaggcccgtccgcaaacaaccgtaaattgtcccagccgctcatatacgggtaaaggctcggatactcgatcaacgacccgactgtcgctaggattgggtgatgatcgagttgcatcgtttcacctgcgatttgaatctcaccatccgtactaagcaaccctaaaattgctttcataattgtcgtttttccagcgccattcgcgcccaccaggcccacgatacgtccttgggcgcattcaaaactaacgtcacgcaaaactggctggtggccgtaacttttattcagatgtttaacggttagaattgcatcggccatttaaatcccctctctttcatgatggcaaacgttttcaaaaactatcgacacattgcgccccccattaaatgacaagtgatcaccatctcggaaaagtcaccatgtgaacgttactgaattatagcccgctattcagttaaatgttattttttggcggcgcacactagtattttggtacggttaaaaccaaccacaggaaacatcgattaactaaccaatcaaaaccagccgacttttgccatgcagcgcgcacgcttgtaatcattgcgtgtgattataagtgaaaaataaggtgactactagatcagctacattaccgatccagcactcaccttatttttcactgttgtgttagttttatggcgccgtgccgtgatttgttcgggtcaataaaccggatgatccagcaccgtccagtccgggtaggtttgatcactgggatcaaactgcccagataacaacacggccttcgccttcaaaactagcggtgacgcattagcttcagtcaacgcatgcaacggcacccgtgatgctccatgcgaatcttgaccatcaaagttagcgacatgttcggccagctgcccagtcgtccgggtcactcggtaaaagaccgccagatgttggttcattcgccactgcttgaactgccagggataccgaaaactcgtgatacccaattgcgtcaattcagtcgggattaacccggtttcttcttgaatctcacggcgaatcgcggcaagtaagggctcaccatcggccaaactgccacctggtaagtcgtagcgattcgtatagggaccaccaaactttttagtaacgaccaacgcatgctcatcgccaataatcccataaacaccaaatgcacggtgataaattgccattgtcccacgtcatttcacgtttaaacagcgtcgttaagcgtaagcgctagctatcttggtgtcaaggcaaatctgagtgtttactgtaacggtaaacatatcagacgattgtaagtttactattttagtaaacattaattcatcgattgtgtttacaaatacagtaaacagtcttataatcagtaacattggaggtagcctcatggacttaactagtttaacgattgatgatttaaaacgcggctggcatcaaacagccactgcccggtattgtaattactgtgatgctagctgggaaacgactacagcggcggccacgatcgaacaacacttaacgatcgtccatggtggtatccagtcaccactgattcacttagcgagtcgctacaatactttaaccactaaacagcaaaatttactgactgcttttgcgactggcatcaaggatgccgacttggctaaacaatttcaattagcggcggccacgattcgacatcaaaaatttacatttcgtgaaaaagccaaacaagctaaattgtacctggccatctatcaatccgtctttgagagtggtcagacgcccaatgatttgattgtcctgccagaacaacctggaattattgatgaccgctttgcgattactgaagacgaagcggtccaaacattgaagcagtacttcaactttgatcatgacccactacaattgaagcggtggcccaaaaagcaaaagacgatcgtcacaattctaacgcggattattgatgaaattccgatgaaccggccaatcaatgaagacgagctcaaccactatttacaaccgatttattttgattacaccacgctgcgccgttacctgatcgactacggcttcttaaagcgtaccgtcgatggccggcaatactggcgcacaactactaaggaggactgaaccatgcaaccagtcgaaaaacatcgcttacaacaaaaatacaaacttgccccaacttattacggcgtcattcaaattaccaacgaacgcaatcataaaatttggattgacacagtgcccaatttacacaaccgctgggccttttatcaactaaatcttaataaaaacttttaccggtccaacccgttacaggctgattggaatcaacaaactgccgctgacttttcatatcaaattctgtggcaaaaggaaacgaccgatgttactaatatgcgtgccacgctcaaagcactcaaaaccaaatggctgcacgatttacaaccattcgatgaccatggctataatcggcgccctaaagattggcaggaaaactaaatgaccaccactaaaccaaacatgcacgccgttgctattaatcctgcagcctggccgcgccaaacttatttttactatttcaccaagatagcccccagcggttttagtctcacggtaaatatggatattaccgccaccctagcttggactaaagcccaccacgttaaattcaacgcggtatatctatacctagtgagtcgcttgttgaccacacatcccgaaatgcgcatcggctatttgaacgatcaactggtgacctttgacgtgttacatccgtcttatacgatcttacacgctgaccggacaatggctaatttatggacgacttacgacaccgattttgaaacgttctatcaacactatttagcagaccaagctgaatttagtgcacttccagggcccatgccgaaaacaccacaaacacctaatctggttaatatcggctgtcttccaggagtccactttagtagctacacgcccctcccattcaaaccactagatagtttctttccaatttttcaggctggccagtttaagaaggacgctgacaaaacaatcatgccgctaagcattacggtcaatcatgccaccattgatggcgatcatctcagtcgtttttttaatgaactccagtcatgttgggaacaaccaacacaatacttagcctaaccatatagtcaaggcccgttatgtgcatttgttatccagcttaaacaccgctcgtcaggtctttttttgaagcgaatgagtcactagcttaatcagtgttatttaccggtgtttgttcgctcatcagattgcgcctttcttcaagcaaccacaccgtaaccactgtccaagtagtgccggccctcgccagtacaattctaagaaattcttatgctagccttatgaaaacgcagtagttgagtctgcttcaaatgggtaaactaaagacattaattaagaaaggaactgatgtctatgcgtcattcacaagtcttaacgatcacggtgaaacaaccgcggcctcggagtgctgatccagctgtcatttatagagtcgatcgccatccttactggcattggaacctaatgaactaataaaaacgaaccgtgcactgaatcgtagtgggctcaaatgcgcggtattaaaaataatcccgttcgatcagccgtgtgggccacctgattgaacgggattatttttggttgcaagctctgcgggtatccggtacactgaagccatcaatgaatggaggaaatgccaatggctgagtaccttgacgctgacctagctgttttgacaccatatctggaaaagctgggtgcaacaccccatcgcgcccaactgattaccttgctcaactgggtacacacgacttttccacaactcaaggcacgggtcgcctggaatcaaccgatgtttactgaccacaacacatttatcattgggttcagtaccgccaaggatcatctgaacattgcacttgaatcacatactttggatagctatcggaacgcgatcacggctgctggtgataaaacaaccaagatgttatggcaagttgctttcgatgcgccaatcaatcacaagctacttgcagaaatcattcaatataatatgactactaaacaaaccatgacgaccttttggcgcccttgatgcgtcagcgttcacgaccccgctttcatgcctgaatccgagtcgtgagcgctttttaatgcttaaactcagactgattgtcaacgcacttaaatctagttgacataattttaatttttatcagttgcagccaaattaatgattttttcaaatgtgaagcggcccgcgtcatactggtacttgatgactgcacagttatgtaacacgatgccttgccgctcaatttcgtccattgacagccattgccgcaaaaacatgaagctagccccaccgtgactgaccgccaacacctgatgatgatccggacgtgccatcaccgccgtcaacgttttgacaacgcggtcttgtacctgcaaatcactttcgccaccgtactgacagaaaaagtcaccatgactgcggcgcacggggtccggttttggatttaacacttccgactcaccttcgaaaacgccaaaattccactctttgataccctttaaacgctcataaggttgcttggtcactaattctaacgtgtcactagctcgttcctgcgttgagctgtacgcatgatcaaacgtaatcccttgcgcctgaaaatacgcacccacgcgttgggcatccgcaattcctttgggggttagcggcgagtcacacgccccctgaatcttcttcagccgattaaaaagtgtttcaccatgccgcatcatatatagtgtctttgccaatttaactaacctgcctttaatttgtctttagataagcataccataaatgaaagcgctatttaaagcgtcctatacattggccagttagagcctacttttgcctacgaacgcgcaaaaaagcacaaccagattttagtctggctgtgctttaaatggcgatattgatcaaaagctcagactaaaaatccgtatcttcatttccctgattcaacgctgtcaacgccgcctttaacgtgtcgccatgtgcaatcaccgtgccggtagcatggcccggttcaccggtggcttccacttcatcataaatttgtaaatgattgtagggaaatgtattcgcctgaacatagactggctttagccggttaacatccggatagtcgtacatcaccttagtcagtgcttcgcctaattttacgtgaagtaataagcgggtcacgctcgacccactggccttactgattaacgccatcgtagcaatgctcatcggttcaatcgtagcaagttgcaaagccgtatcagcaattgctaaccgaactgtatagagcccgggcgcacccatggcgagcactcgttgcttgatttcagcgtgtaaagctgtaattgcctgattttccgccttatcacgaatcggaaatacttggaccgcaccacggacattgccacgcaaattatttcccgcaataatttcacttaccccaaaaattgtcacatcggtgccgtccgtaatcacctcgacggcgggcgaatcattggtcttgatctgctcgcgcggcaagctattgttgatttggatcacttggtagccatcctgtactaacttctggcccagccggtaatcatgataggtggtaaaaacgatcaacggcttttcaatcgctaagacgtttaaaatatccgaatactgtttaggttcaacgtaacgttttttggccaatcgcggagtcatcgccacactattagggttagcgttgatcaaaacaggctcataatcagcctttttcaagtagaacaacagttgtgagaccaaatagtcgttcccatggttggttccgatccggttagcacccgtgccaatgacaacgactcgccgaccagtagacggttgactttcgttatcaaattcgtacgtggagtaataagtactcgtctgctcagtaaattccccggcagtcggttcgacctccttaaaagtcggttgaatttcattttccaacgcaaagttgcgaaccttagccacatccgtttgccaggcagcggccgcatcttcatcggtaaagccaaaatatttggctcggcccagcgcgtggacgtcaaacggccgttcacgcaaggctcgttcaatttctaaaatatgactcagtttataaaagtaaaaagcatcaatcttggttagctcggctaattcatcgatttgataaccacgattcagggcttcaagtaaaatcagcatgcgcccagcttgcggatgaatcaaccgttggatcagttcaccctccgaatagttctggggtcgattagcaatcacgtgatagcgagattcgtccgtagaccgcaaccccttcaacaaggcttcttccgttgaacgaccaataccgatcactgagcctgtcgattccgtcacggtgtctagttgatgactaactttcttcaacacattaaacggccaaactggtatccggcaaacaatatgatctaaaacgggttcaattaaagctgtttgtttacggtaggctccgggcagtttgacctctgccaaacttatcccgaccattagattaccaacaacttgtgctaacggatactcggttgcccgcgcggctaacgccatcgtccgatcaaagtacggtgtcactttaatcacgtaatagttttgcgtggtcggatcaagtgcaaattgaacgtgacaagagccggtcaagtgtaacttgcgcatgatcttgagtgtcgctgagcgaaactgttggtattcttgatccgtaatcgtttgcgttggggcaaaaacgattgaatcagcggagtgaatcccaactggatcaaaattttccaccccactgactagtagcgcggtgtccttctgatcacggacggctacaaattcgagttctttatagccgacgatactctgttcgacaatacattgtttggtccctgaaactttgaatcccattgctagtgcccgttgcagttcgtcttcatcttcacatagttggcgactcgcttcgattcggggtgcgacagacttgacgatcactggaaaaccgacgtggcgcaccacggccatcgcctcagtcgtgctagccacaacttgtgaggcaatcacgggttcacccatatctttcaaccggttgctcatcagcgctgggttgacgatcatgtcgaccacgtcttgatcccactgtagcaacttcacgtgattattttttaacacattgttgcgaatcaacccttgaattagggtgactgtttggacgccaccaagtgaaggaatgaggccatcaggctgttcagtttcaataattttggatagtgcggcgacagtcagtggttccaaataaaccttgtcagcaaaccgattttcagccgccacggagtaagcattgttatcgacgaggacaacagcaatgcccagacgccgaattgccgcaccgatttgggtcaccgccgcgtcgtgttgtccctctcggccaatgtcattatgcccagcgccgataatcaacactttttgtaaggcttgattgttcaccagattggcccccttgcttgttgcatcgactcaacaaattcatcaaaaatatcgcgcgtttcagtcggaccaggagcgccatctgggaaaaattgcactgaaaacgctggaaagtcccgtagacgcagtccttgaatcgtcccatcgatcaagtcaacaaatgtcgtgattaacttattacgatcaacagtatccgcatctaccgcgaacccctggccctgagctgcataaacaatttggttcgtaatcacttcgcggattgggtggttagccccatgatgttcaggtgataatttcataatttgagcgccattggccatcgcaaatagttcgtggcccagtccgatggcaaacagtggcacccgattttgaatgttcttgatcatctcagtcacactgactggtaagtcctgcggtttgccgggcccagtcgatagaatgacgccgtctggatctaagtttaaaatttcctcagtcgttgccgtataaggtaagaccgtgacgttacaagcacgcttactaagttcgcgcaaaatcccgtgtttgaggccaaagtcgatgaccacgacattgagccccgtccccggattaggaaatggtttcggtgttgcgaccgctgccacctgttgattagtcagcacggtcgcacccaattgatcaaaggcatgggcatctgcaacgtctacgatactggctttcatcgggccacttgctcggagttgcttcgctaagtgccgtgtatcaatatggctgatgccaggaatattttgttgctttaaatattgatccagtgaccagcgccgctgccggttggtcgaaatgctagcgacatcccgaacaacgacccccttaacggtcggtaaaattgattcgtagctatcgtggttgatcccatagctcccaatggttggctgcgtaaaagcaacgatttggttatgataaatttgattagtaataatttcttgatagcccgtcatactcgtgttgacgacgatttctccggtagaaaccgctggcgagccaaagccttcacctaaataggcgctgccatcttcaagaatcaaatagcggtctgccattgcgatcccttctcatctgtttgactttgtcgtactagttaataatttcaataccatcgtgaccgtcgatttcattgaccgtcactttgatgcgttcttgacgcgcggtgggaatgttgcgaccaataaaatcagcgcgaatcggcaattcgcggtgaccacgatcgactagcaccgccaaggcaatgctctggggccgaccgccacccattaatgcgtctaaagccgcgcgaattgttcggccggtaaatagaacatcatcgactaaaatgacccgcttatccgccaccgaaaacgttaactgatagtccgttgaaagccgtgcttgatccagcggctgatcatcacgaaatgccgtgatgtctaactcgccaactggaatcgcagtaccttcaagctgttgtaattgggctgcaatccgctgcgcaatatagacgccgcgggttttaacgcccactaagacgacatttttaatgcctttgttctgttcgataatttcataggtgatccgggtcaatgcccgtttcatcgccattgaatcaacaacttctttttgcataattgcctcccaatttgtggttatcgcttttttgagcaacccgtacgacaaagaaagacggccggacaaggtgtcacggccgtcgacgaaaagttattgttaacagtttgcctttcagtctcgcagggccggattaaaggacgctcattactgttagattaatgattcccatcggttttgtcaagcttagccaaggttgtcgtaaagattggtggtagtggtgcttcaaaggtcaataagtcacccgttacggggtgcttgaatcccaataatttggcgtgtaaaaattgaccgtgccccttaatcgtctttttggggccgtacaggggatcgcccaccagcggatgtccaatagattgtaaatgaacgcggatttgatgcgtacggccagtctccagccggcaactaatcaaagtatagtgctgataacgtttcagtactttaaaatgggtgactgctggtcgcccggtcttaacgatggcttgctttttgcgatccttcggtgaccgaccaagtggcgcattaattgtccccgtatcctctttaatcactccgtgaacgagtgcgacgtattctcgtaagttagttttcgccttcagctgggccgccaacgattggtgagcccggtcattttttgcgaccatcaataatccggatgtatctttatcgatgcgatgaacgatccctggccgaaattcaccgttgatcgtcgacaacggactatgatacagcaaggcattcaccaaggtatggttagggtgcccaggggctggatgcacgaccatcccctgaggtttattgacaaccaagacgtcatcgtcttcataaacaatgtctaatggaatgttttctggctcaatcgttgtttgttgaaccgtctgtgcggcaacgacaatttcgtcacctggtttgacgtgatacttgctcgcctcgagctgaccattgaccgtcacctgatccgttttgatcagcttatcaacttgcgaccgcgtccagaccgactgtagtgccgctaacactttatccaagcgccctgtttggtcagtaatcgtgaattgttgttccgtggtcgctcctgccacgctatcagctccctgtaacttatttttcaaaactatcatcccgcagcacgccgatcaagataaaaatgacgcccacggttaaacatgaatccgcaaaattaaaaattggaaaattaataaaatcaagttggaacatatcgacgacgtacccaatacgtaaccggtcaatgaaattccccaaagttcccgcaatcatcagtgaaataccaacctcatatagccatttgccacgtaagcgccacagcaagtagcccatcacgatcaaggcaatcactgaaatcaagtagaagaaccacatcttgccttctaagatactccaagcagccccgttattatgtaaatttgtgagtgataataacccggtaacaatactcgtactggcacccaacgcaatatgactcacaatcgctgctttgataacttggtcaataatgaccagcgctaccattaaaattaaatagatccacatattctgtcctcacatttcgctaagctgtgtttaattataccaaaagacgtcgtccttgtacgaaactccggcaggaaaagcgcggtttttattgcagacttaataactaagcacctttcgagtatcctcccaaaagcatcggcacctggttaaccatcccccagttgaagcaacgagcctgatgattggttgcaccgctcagctgctaagcgagttagtcatcatcggtagctcacaaattaaacgtgtgtgattgattcgctgtcgcagtcttccaaaaacaacgcaaataaaaagccgacccccactggcatcgacttatcggtcaagctttagaacaaacctgagatttttccatcatcactaatgtccatatcgagtgcggccggatgttttggcagtcccggcatcgtcaacacattcccggtcaaagcgacaatgaaacccgcacctaacttcggcacaaattcacgaacattaattgtaaatccggttggtgctccgagacgtttgggatcatcgctcaatgagtattgcgtcttcgccatgcagactggcaaatgatcccacccttgcttagcaaacgttctcaattggcgctgagctttcgctgaatattcgacattggctccaccatacgtcttagtgacaatatcgttgattttcgtcttaagatccgcatccgctggtgataacggttgaaaatgacttggctgagcacataaatcaaccactgcggcagctaagtcggttgccccgtcacccccacgaccccagacatcagccaagactgcatcgactccaaggtcggcacaatagtctttgacggcttggatttcggcgtcagtatcggccgtaaattcgttgatggccaccacgactggcaccccataacgttgcatggcatggatatgatgtcctaaattagccgcaccggctttcaaggccgccacattttcggttgccaaatcttgcaaagccacgccaccatgtaactttaaagcccgaatcgtcgccacgattaccacggcattgggcgcttgtccgaccgctggcacgttaatatccatgaatttctgaccacccaaatcagcaccgaagcccgcctcggttaccgtatagtcggctagattcaatccagcttgcgtggcaagtacactgttacaaccatgcgcgatattggcgaacggaccaccatgaacgagtgctggggtatgcgccagggtttgaactaaatttggacgtaacgcgtctttcaaaagtaacgtgatcgcgccaccgacgttcaaatcagcaactgtcactggttgacggtcatgtgtgtagccaattacaattcgattaacacgttgtttcaagtccgcaatattttctgaaagacagagaatggccatcagttcactcgcgacggtaatgtcaaacccatcttcacgaggtacacccgacgttgcaccaccaaggccaatcaccgtatgccggagcgcccgatcattaatatccaacgcgcgcttccattgaattcgacgctgatcgatacccaactggttaccttgttgaatatggttgtcaattaaggccgcgagcgtgttgttcgcagccgtcagggcatgcatgtcgccggtgaagtgcaaattgatatcttccattggaatcacttgtgagtacccgccaccagtggctccacccttcatccccataactggtcctaatgaaggttcccgcaatgcaatcatcgttgacttaccaatcttagtcaacgcgtcacctaacccaatagtcacggttgactttccctcaccagcaggcgtcgggttaatcgacgttactaaaataaggttgcgttgagttttcttaaccggtaacggtaatttgagtttagccttcgtgctcccatattggtcgatctggtcaaccgtcaagcccgctttagccgcaatcgccgtaatcggttctggtgtcacttgctgtgcaatttcaatatccttcatcaattctccgcccttctgtttttacttactccattataacaatcttcctgaaattatgaacattatttatatattgattgtttttattcgtatctatcgactagttgctaggtcaatcaactgattgcgcgcctttttcaacatcaaaaaccgatattgattaccatcgatttgaactttcaacccaccgcgtatcgggacgatcaattcgagttgatcacggggaatcacaagccaagaatggttcaagaccgtgctaaaaataatgaggttatgattgattgttacgcgccgcaagctgatttgaatcgcgaccaaggcaataaagagcgccgcaatgacgagtaaccaccacttaaacttcaagatttctagccacaaaataatccccgccatcaatactagtgccgtccacgaccagacgatcacacttgacgctagcattggttggtatttaaaggtatgcttatcgttattcacagtacaaaattcctttcacattggagtgagtttgatgcaattatatacggatgccgcgaccacacccgataatcagcgcagtgccgcgggaatcttaattattgatcagggccaacaacaccaattcaaacaggtcttgccagacagtgataatcataccgcagaatttcttgccgccattgctggctttaaaactttattagattcttatggtccgcaagtcagcgtctttttctatacggatagtcaaatcgtcgccgaaagtgtcgccaagggttacagcaaaactttcagtgtcgagctggcgactttgctgcacctgcaagaccagtgccaattagtaatcacccagtggattgccgaaagtgataaccatggcgcccatcaattagcacaacaaggcttacatcttagtgactaatcagccggggccaaataagtttcaattggtcgttgatactggtcccagttatgagcaccagtttgaacataatcggctaacaacttaccaatcatgggtcctgttgttaaaccagatgaacctaacccgctagctaccaaaatatgtgggttatccggaattggaccgaagaacggcgcaaagtcacgcgtgtaggcacgcgtacccacttttacctgcgtaatttgatccttagtcaggttggcatcaagtttgagcccgctagcaaagagatcatcttcaaccagacttgaaacctgcaaatcgtagccctgatcattttcgtgcgtcgccccgacgaccaatttgctgcgcgtaaagggaataaagtctcgttcaccttcaggcatgagcactggaacatcgtcagcccaagtctcaggcagctgcatttcaatcaactgccctttttgtggccgaacatcagcaacaatcttcattggcaacaataacggctttagccacgccccgactgctaaaatcaacgtgtcatagctttgctgaccattaaccgtcaatagttggccctggtcacctaaacgtaccttacctttatgacggaccaggttccgcttttcagcgtatttcagtaaattatgtgcaaacttatcgccatcgacccgcgcaccaccactcacaaacacaccgggttggggcgccgttagcagtgggatccgttcttggacttcttcagcagttaatttctcaatcgttcccatctggggtgccgcttgccggcgctttagagctaaatcgtatagcgcctgcagatcatctggatcggcacgagtcacaatcgttcctgcttgttgataaacagaatagcccatttgcgtgtccgcaacaatttccggatacaaagcagccccggccttagcgagttgataccaacgctgattacgacgtttggataaccaaggtgaaataatccctgctgaattcttagtcgcttgaccaataccttcatcataaatcgtgacgttcaggtcagggttctggcttaaatagtacgccgtgaccgccccaacaatgccactaccaataatcgttacttgtttttgcattttccaacgcctccacaaccaatctgctttcattttagcatactcgaatttgttgcgggtggctgattcagttggattaaagtcagaccattggtagatgttgctggtactagctttgcagcgattaatttaataccgtggactggctctttgccccctatgactgggacagagcaatcaatagttgttgccggacaaaattttcgttcgtccagtgtaaataatgctgacctggtgcatgaactaggtgaccaagctggcaccacggtgattgttggtacgccgtcaagcgttggtcagtgactaaaacttggattggcagcgtcagtacccgcttttcagcggttcgaagcgtcgttactaattgtggtaagcattgcgcttcagtcagaatactcgggttcgcgtaagctgctaaatcaatacgggcattggcgacacgttctgccagtaggtttaaaggattaacttctgctaagagttgctgaagtgtcaaagtttgtcgctgttgtactagttgcggatagttttcaataaaagattggacgtttgcaagaagttgtggtgctatcgcggcatagggtggttcaagcaaaactaagccacaaacattatctaagtgctgctgggcatataagaatgcgtaactagcgcctaaactgtggcccaccaataataagttgctcacgtgttcatggtgaaccacatcctcaagattggctaaaatatgcgggacagtgcgcaccatttgactatgaatgctacggcccacgccaatcgtgtcggtggcaagtaatcccacctgacttggcaatcgtgccattaaatgcttaaaattataatcagtggcgtcccagccaaacgccggtaagcacatcaacgtcggctgttgtggtcccgccggtcggtactgatagtacacttgtcccaattccgtcattaattgattcatgattacttgcctcccacaatgacagacatcgtaagtagttccaaatgcttttttattacagataaaacacagctttacaatcagtcatgcatagtctagtccacaactgatcagtagaaaatggtttttaaccgcttcgttaaatcaactgaccattaaaaaagttacaagatttaaataatcgtcacattttgaccatattttcgttttacacttattaatatgcacgactatattgttttaaaggacttttgccatgttagttattgtttggattcttttagctttattgttagggctcatgggttggttggaataccacaatcttcagcatccggtcatccagccagctaaaaccctggcgccgcgcgcgcagctccaattgcaacatcaagtgcggcaacacgtgaccgatcaagcaccacgattgaaatggttatattatggaatggcagcttgctggtggctcggtgttatcagtttactagtcagttgctacttggtcagcgcaaaattaaccatgttgatttttccgattcggagtgttgtcacaagcatcgccttaatgatcgttggcatcatcttgctaatgattcctgccttagtgtggccaacgcaaagttatgattacttgattggtcactcaactcaaggccatcattggcagctagccgataccgccacgtttgaacactatcgtcgctttcagatctggttggttttggcattagacgtcttcatcctgattggttggattagttgggcctaccgggtcagcaccgttcccatggtcaccattgagtacctactaatggtggcggcaatcgccgtaccagttgtggcattgatcacgctgttagcacaactgccatacttacatcaaaaccgatacttgattccggtcagcgggcgctttggcacccagcattatcatgcgaatcggacactcatgcaacaacaaccggacttaaagtcacggttaattatcgtcaatgttgttcgaattattggttacgcgttggggttgtatgctttatggttgttatatgccaacattcttgcaccggcctttacggtcgataccagtatcgtttaccccgcagcggcgtttgccatcatcggattgttaatcgtgttaacagcgggcggtgtgtggcttccccgtttctatgattacttgcaattattagataacaagaccttgacgttcaaattggccggtagcgaccgcttccgtcgttttcgttttcatttgtattacttcaagttggcattcagtattttatggatcgttatctgggcattgatcatcggttatatttattactttggctaggtacgctcaccaataatacgcaaaacggtactcaaactaatctgagtaccgttttttagtgtcattttatgagacttgccagcggggccaacttgagcgccaaaggactcaaaataagtgtcgccattgcggcgcaagagccattactgttatattactgcgttttgaagagcgcaacaaagtcagcttgcgcgctcgcagcttcaaacgttcgcttggacagtgtcgtcacctgccgattattgagccacaacacttggtaatctgtaaaagcatgaaggtcgcgaacgtcatgtgtaatcatcaagtaggttcgctcaggatgggcttgcatgacctgaaacaacaactgcacgttttcccgatcgaccgctgctgttggttcatccaaaacaatcaattcgcgatcaacttgtaagaacagcaataactgaactaatttgcgttggcccccagaaagctgaccataatgctgatcccacaacggggccaagaattgataagcttgggtatcaataagttgttggagctgttcagttgtcaatcgtagtcgtccgtgctcgatgcccaaaaccagttgggcaacgtcccgcacacgaattgaagacagtaacggaagttgttggttcaaataaatggctgctttaggtaggtctaattcaccttgtgccggccgcaaaccagtgatgatatcagccagcgtcgtttttccagctccattttgaccaatcaaaaaattgacaccgggactttttaattgaaaactcacgtccttgaagaacggttgcccatttcttgaaaactgatatgctaagtgctcaacacgcatcattataagccctccgttggcagaatcttaatgtgccgatagctaaatccgccgataaccaataatacaatcagactcagaagataagtcgtcataaagtggctgacgtggcccacgctgatcatcgcaaaaacattggtaactaagtaaatgggactaaccaggttgagtaatgggttattggcagacactgccagcatgttactcaacataaaggtacctacgacgacgatcagcgccagtgcatttccaatcatatcgacagttttacgtcggagtgccaaggcaatcaagggtaagccaaaacaagtgactggtagatacgtaagcaacacagtcaaccataagcgacctagcaacgataaaaaggccaacttgaaagtaatcgcgctcaacagggccaccaacaataaagtcatcaaaattatacccaagctgaccagcgcttgactgacaagaaaaactgcggggctaaccaccaaggttcgatattgtttgagataaccctgctcgcgaagaatggctacattgctggcagtcgttagacaattggaaaaaatcatccaaccaatgtagggcacgacttgagccgtataagttgtcagcgataaaggtttaaagaaagcgctactgacattcatgattaaaaagacaagtggcaaacagatcgtgtaaattaacaccccgggagtatcccgaatgaccttaaaaaaatactgcgtgtagacccccacttgaacgctatatttgtgcatcaccatcacaccccttttgttaatctaattgttttattatatgtttatcatttatcaaaaagcaagtattcttataccaggcatgtaagtatggccggtttacaaagtttttgagcttgctaaacgtctttaattgcaaaaggtagtctaaaaatgactaaacgtcaccgttcgagcctgcgcatcaatccggacatccgcccccaatggcgtactgagcatggggactgtatggcagctatcgtagtcgtaaataattggtaattggcgatcccccagcacctcctgtaagatatcgattggcaaccgcccgctgccttgatcatcgtacaacgcgtgttttcccaaaataatgccagagatttgatcaaaaacaccagccaacgctaacattacgaaatttttttccagcgttgctgcagttttctcggcatcttcaataaataaaagctcgttaccagttaattttggaaaataaggtgagttaaagaacccgtacatggtgttcaagttcccaccgatcaaacggccagccaaaacgggggtcgccgtataatgccaagtatttgcgtgcatgtgtttcggatgttcaaaggtctcccaattgaccgcttcatccgtccactgtgccggtgcctgttcggttacggcctgccccggtgctgcgcggtagactgtcagaaaattttgccaagtggttgtcacgatctctgactctaaggcgccaagtgaggctactaaggccggtccgtaaatcacacgacagttaggcgcgtgcgtttgcaccgccaataacacggccgtcgcatcggagtaaccaacaattgttttgggatgctgattgagatactcgtaatcgagcattgctagaaccgaatttgcgtttgtcccaccaatcgttgccatcaagatgtccagcgaatcatcatgaattaacgcgttgatttcggccgcccgttctttgatggaaccagcacggtaactatcccgtcgtcccgtcaaattgccggcaactaaggtcactccttgggttgcaaagaaccgtcgtgcgcgagcataacggtttggcgataatgccgtaatcggcgttgatgcagaaaatgtcccaattttcattgtattcccaccccgcaagattaaaatataattaaaataattgtagcactttttaatcttaacgtacttccaatcgacgtatttcctcaaaaaaacgactttcagctaataacttgctgaaagtcgtttagtaatcaactggctatgctcgttttgagcgacttaattgacttattgtgtgaccacgtttgagcggttggctgaaacgtaattccctttatccgttaaataatagcgtgagccacccgaccgtgagtaaaccttcgttactttaattcgatcaccagcggcgtggtaagcgtgtcgattagacttaacaaagtttgaagatttataggtgtaaagtcccactttagccttgatccagccactggaaggtactgattcatagtaccaatgatcagatttggagaccttcgccgtgatataaccaccactcaccttaattcgatagaaattcccacttttaaccaatttaccactgtagatgccaccctttttcaaggttttacccgtcgaggttgtcaaattaacatctttgaacaaagtgctcttttcacgaagttgatataatccgtgttggccgacccaatagccggtgacgtcctgtgataagacccatttatttagaccacttaagtaaaccagctgcttggaacgactcttagtgactgacttggttgctgtgaccttgtagtattttttcttagcgctactgggcacttttgtgccatcataatagctcgacgccccattattgaggtacacatgttgccctttcgtataactgctgtaggcatacgtcgtgctagttgaactggtcgacgatgatgccgaagtcccggaagtccaccagcttaacgggtggtatgtcgtcacggaagcactgtcatacaaactgttatcaacatattgtcctagcgaagataaataatagctactggaatattgccacaatgagaacgaaatcgtcggcttcgaggagtaatttgcaatccactgggcatcaaaactttgccgtgccgtgttggcgtatgtggttgcaaatgactggtacgaataaaaaatcaacttcttgctcgttaacgaccgcatctcagtataccaagccttgacaaccgcgttggccgccgtgctactcatggaagtcgtttcaaaatccaagacgtagaacttcgtgttcttatttgcgcgttgatagaacttatctgcctcggctttggcagtcgcggtactcgtaaaggtcgcatagtcataggacccgaacggaacaccatatttcacatagagactctcattagaggtgtggtagagatcctcataactgctcccatattgcacccggttgatgacaaaatcagcctgactcttcaaactttgaacctcggtactcgttaactgaccttgccactctgagatatccggcaccgccgcgtgtgcctgaacgactccgataccacctaaaaaacaacccacgagcagcagtatcaaccgccactttttctgcatgaccaaattactcgccttcccatcattagtttgatatgtacgtttactgcacaccttatcctaccgataaaatgtgcagataagttctcaaactgattgcagtcgctttacaatttgtttacattataaaccaatgcaggaaagtgtgatttactagtgaaatgattcatgtggaaacttttctaatcgatataggccttcatcatccgggtagattcctccaggcttaggtcgatacccgaagtgttggtaaaataagtgcgcagtcacggacgctggaatttctacacggtgggcatgactgaaatagacatcctgttcaagggtatgcagaatttgacgcccaccacccatgccttgaacctccggatcaacaaaaatcgtgaacagactgtactcacctgggcgcccccagtatgacccaatcgccccggtcgcaacgagttgctgctgaaaataaccgacataaaagtgcgtcgcagcagctttttggcatagccaagccggtgtcatctgggtaatgagccgatccaagtatgctttgggatagtcaccctgattactcgtcagtaatgtgcgcgcaatcagtgccgccgctgctggcgcatccgtagttttaaaacgtcgaatttgtaattgcatatgacaactcctctcgtattgcactattctttgatcgttgcaatgaacaacgaatacctttttgatcgtctgccgataccaatttaacaataaccacttaagcttccacaaaccaaggttctaaaatttttaacgtagcttgctcaaaatcgatacacacttgcgccccatatggaagtgccgttcgcggaaaagcgtgaccaaaattaatattgtacagaattggcaatttcaaatcggctgtctcatcgatcaaaatttggcggtattcctgataataatgctcattctgcggcttacctacaatcacggcggctacgtttgtcaaaatctcagcttgtcgcattcgttgcagcatccgcttgaacaaatctggctgcggctgttcgtcactcgtttcgataaacagaatttttccgcgccattcggctgcacatggaatcagtctgaactgttccgcaacttgccgttcgtctggataacgagtcgtggtcaataaatcataaaagctgtccaggcaaccaccaagtagcgtcccactgattgtcccgtgaccacgtaacacttcgtaatggtgcatttcggtgtgggtcatgcgccgtgttccctgcgccgattcactgaaatttgttcgttcgtcataccacacgggactgctaataatgcttgtctgctgaggattttcaaagtaacgctgccaagtcttcgtggtatacggcaacatcgtcggccctaattcggccaagtcgcttaagaaattggggccataaaaagtttgcagtccaagctgataaaacatcaaatgattgatcgtcgtatctgaaaagcctgtaaacagtttaggcgaccggcgaaccgccgtcttaaactgctcatcagccatcaaaaatggcacggttcgatacgtatcatcaccgccaattgccgccacaactccacggatacttgggtctaagaaagccgtcttcaaatcggcggctcttaattcagggcgttgctgtaaaatcagtcgccctttcaaagcattcggcatcatgactgggacgagccctagttggcgcatccgttttagcccccgattcaattgatgctgctgcgtgagttctccgagcgtgccgctcgaaagactgacgacagccacgtggtcaccaacgtgcaatggtgctggttttaacatattctcaccattttctaatttaatttaaaattaattttatcatcattatataatattttaaattgttatttggtttttattcattttcaatgtaaccaacgactaaataggtcactgagtccgctgctctgcatgactcagtgacccgtcgccctattgtagccaatcttttatgtcaaccaagcgaatcttatgcgtacccgctgaccatcgttctggctgtgccttaaccattgtcagcaactctgttagtgactcggaaccaacaatcaactgttgcagtaattcagaaatcagtggggaacgtggttgcgcaccaactaataaacaatgttcaccttcaaaggctaacacgtcacctcccgcccgtaaacggccaaacgggcggtgcaacttgacggtacccaaaatcagcaagccaccttgttcaaataacgttttcaacaaccaataatcgagtttaaagtggttagaccgttgtcgtaaatcggccggcaatgctttagctaccggtataatcgttttgaaattccgactatactgatgccacgattgagcccagtcctcacgctcacagataaatcgccggggtaatgtcaattgacctgcataatcacaaatttttttaatagccggatcactcattattgacggactggcttcaaaaataggacgcaattgtcgtatcagttcaataaactccgctagataatcggcaaagcctggcgttgctaaattaatcaaaattcgcttagcgacgcaataagtcaccgcatcctgatacgtcaccttggcgtgctcaatggcatcttgataggctgtcataatatcaaacagtcgtgggttggtataatctaaagttgtcgaaccagcatgtttataataattataaaatggttgttgcacatatgcgactcgctcacagcaactcaacatgtccagcaaaatatctaaatcctcgtagaccatccgctggtaacgatatttctgccaacacgaacgtgcatataatttatttccggaataagcattatttagaccgtatttaagataagtcgcaattgccacatgatcagtcgcatctggcaagctcagcagactagttgtgcggtgagtcgccgcgtagattttacgaacatcacaaacgacgatttgggcatgactacgctcagccgttgctactaaggtcgcatacatcgtcggttcgacccaatcatcagcatcgacaaaacctaaatagcggccatgcgcggcggtaatccccgcattacgtgcaggtccctgtccttggttacgttgatggataacccgaaataggtgcggccagcgcgcacaatattggtcacaaattgtagccgtgccgtccgtactaccatcatcaacaataatgacttctaaggccgctaatgtctgtttttttaatgaggtcaaacaacgccttaaccagtgctcctcattatatgcagccacaataacagaaacttgaacttgcatactgattcccccaacgctcaaaatgatttcgcttacattatgacacacatgcttcgcatatcacagcacggatccatgataaggataatcatgcgcagtcgtggtctgatactctcgtaaatcgtcgatacgtcctgctaaattaaaatgaactgccgaaagcccatcaaactgagtcatccggtcagtaacagcggtgaaggaccactgagcaaagatcatgttgtcagttgctgaccacaaccgctgaatcgaccacgccgttacccgttgaactcttaattgatgttcaatccaggcttgaacttccgctaatgatagatatgctggtccatagcattcttgataataacaatcgaccgcaaatattcttggtaacgcttcaaaatcacgagtgacccacatcgcaaaatattgctggacttttgcttttcggtcccgaagtagtgccgtttcgatttcggtcatttataacaccttccgttttaagattactttttagaggccgtaattctagttaataaacaggcgattaccattattttaacatcactaacaattaacaagaccaaatattgactaaacaagtctatcagttgtattcagcagtcatttctggcacagttaacttaatcataatattaataaagtgagccgataaatatgatcaaagttactaaccgacactttcaagatgtgcctgcgctggaagttgttactacaacccatttagaccaaccgctgccactagtgattttttaccacggttggcagtccaataaagaactcgtcttgacccaagcacgtaaactggctcgcaagaatttacgagtcgtcttgcccgatgccatgaatcacggtgaacgacaccaaatcgttagccagattccttcatttactttttggaacagtatccaaggtaatcttggcgaattcgagctaattgtgaattactaccgggagcgtaaactcattttgaatgagcagattggtgtcggcggttattcaatgggtggcatgacgaccggggctttattgacccatcatcctgaaattaaagcagccacaatcattatggggacccctaacctgaacgcgtacgcccaactagtccgcaagcatgcgcaggcccatgcttattacattcccagtgatttagccctattgacgagttggctagatcactatgatcttaacctgcaaccggaaaccatcaatcatcggccacttttattttggcatggtactgaggatgaacggattccttattcacagtctcgtaatttctttgaccgcgtgcataccgccccgtatgctgaacaagtggcatttatcacgggttatcaagccaaacatctggtcaaagtgcctctgatgaacaaagttgctaatttcttcgattattatttaaattaattatcaaagactcaaccatggttaacgttagccttaaaagagcgtgcttagtcggtcacccgattaaacacgctcttttaaggctactcaaactatctatcacacattgtaatgatcgttattgtcagctacaagttctttgaatttcttatttgccaagcacaaccggcgcctatagctgaaatcaatgctgtactaaacatgactgtttgaaagccaattgcattcatcgcaggtacccgactacccactgtaaacaccaccacagcaattgccgtgccagccgcacctccaagtaaccgaaaaacgttgtaaattccggctgccttaccgataactgccggtgacactccccccaaaactgcatgctgtaacgcggggcccgccattgacaatcccatcccagcaattgccagcggagcaatcatcataacataagcagcatggttggcaactaggtaaccaagcatgaaatacccaaatgtttgagataatagcccgataactgccacaatcgcttccccgtagaggtccacagctttgccagcaaatggcgcaactaatactagtgtcccagtccaaggtaataaggacaatcctgcctcccacgcattatcatgctgaacaacttgtaagaattggggtaaaaagaaaacgactccgtacatcgcggcatataataaaaaagtcgccacattttccatcgtaaaaatacgctttttaaaaagcgttaacggcattaacggtgcaacgacatgttgctgtcgcttgataaaccaagtgcctgcaactaagccaattatcaggccaacgaacggacctattccattaatactagtcgaactggcagctaaggcccaaatgattgcggtcatcgctaacattgaaagacctgcgtccgttaaattaattggtgttgctaccccggtactttctggtaaatagaaccgggataatcctatgacaatcaggccaagtggcacattgatccaaaaaatccactgccaggttaatttagctacaattagaccacccagagccggcccgacaatcagtgccagtccaccgatactgctccagattcctaaagctttcccacgcttcgcaactggaactgcagccgttaaaatagccattgacatcggtgtcatgacggaggccccaatacctgcaatgacacgtgccactatcaataatggcattcgattggctaatgcacaaaacactgaacccagcgtaaaaactaaaatgccgagattataaacccggcggcgtccaaagcgatcacctaatgcaacgcccacaagtaacgttgctgcaatcgcgacattgtaagcgttgagggcccactgtaaactggcctccgagatgtcgaaatcaattttaattgctgttgacgccgttgtcacaatcattgagtccatcattgccataaaaaactatctgagggcgccgcttcgctctaccctcgtaatcatgatatgaaacaaccgccttctcagttataatgactgcgaaggcggtttcgtgttcatcgtgtgcttattggtgctcgctttagcccgtataaaaaaccgatggctttcagttcatgagattaatcaattgtcgtttcgtacacgtaaataaaatttcaaccctcaatgactgaaggtactgctttcaagattattaggaggtgagttttatggaagtcgttgctgaaagtgttgctggtattgatgtccatcaaaaacagattacagtttctatattggtgggcttggctaacgccaagcctaagaaaatctcgaaacgttttgaaaccattacttgtcggcttaaagattgcggtgaatggcttaagcaacgccatgttgaacaagttctaatggaaagtaccggtcagtattggcgaccggtttggcaaatcttggaacccttcggtttcaagatgatcctgtgtaacccgcgaattgttaaaaacattcctggtaaaaaaactgatcaaaaggattccgaatggctatccgaattggcgcgttacggcttagtttccgcaagttttgtcccgccaaagtcgattcaagcattacgcgaatcaactaggttacgtaagaagattacccaatctatgaccgcaaccaaaaatgaagtccataatcttttacaacgctcaaacattaaattaacgacctatatttccgatatttttaacggaactggccttaaactgctgaagttactcatagatggtgaagtcatcactttacaggccatcacaaaatgtcgccacacccgcataaaggctagtgttgaacaattatttgctgcgatggatggcattctgccacgcaacgatcggagattgttgggcttgaatatggaactactcgctgattttaggcgggtattggctgaactggatgctcaaattgatgaacaaattatggaatttaatgatttgtatcttcgcctacaagacattcctggtatcagtcaacggattgctcagataatcattgccgaagttgggtcagatgtaagtccatttccagatgctcatcatttagcttcttgggccggtctctgtccggggaattatgaatctgccggtatcaaacatggtgctcatatcttacatggcaatgtttatctcaaatcagccatggtaagcgcggcgcttgccgccaaacagtccaaggaaaccggtttaaaagactacttttggcgattgcacggtcgcatgatcgcgcaaaaagcgctagtcgcactggctcataaattattacgaattatctacgtcatgattgatgaaggcaccacttatgtagactataaaaaggaccaacgcaaggcaattacgttgatcccacaaacttaaatactagctagtagctttagtatactagttttttttcaacactttcgagtgctttagattagtgcgctcaaaaattattttgtttcaaataaaagcctaatgaagttaacgctaataaccagccaaactgtcgctgtcgattttccatgttttccgccccattatcatttattcagacttaccaatgctgaataagcctactcacaaagtttaaatctactatgtcaatctttttcttagatttagttgggtggccacccacaatagttcaaatgtttttgaactattacagcgtaccatcccactaacgattcggcaacaaaaaaataccagttcaaaaggccaatcggcacttaagaactggtattagtcagaatcacagttgaagaccgcccaaaatactcagcaatttaaaggctttgataaaaatgggtaacatagtgatcaaaagttttggggttcaacatgacgtatttttcacgtgcaacttttttgacggttattaatcctgctttttccagcaatttaaaatgatatgaaccagcggttttactaatccccattgcttgtccgacttgcccacaagtaacggcctgatcctgcagcttcaaatacttaacaatgttcagtctaaccacgtcagccagcactttaaatactaatagctgctgggaatcaacttcagaccgcggtatttcatttgccaatatttttcacctacttttaccagcaaaggtcgcttgcttattccgtccgtgctggccgaattcgtttgccccaatattggaaataatctgtccgtaacgcaccgttatagagtttccggcgtttcgtggctttttgtccatagaagtcttcaaattctaagtcactggtcaggatatacttgctccaacttggcaatttactgtaaacttggcccatttgccgatagagaatccggacactatcccgatcgcttagccgctccccatatggtgggttcgcaattaggaccccgttgatcttgtcagtcgtaaagtctttgacggccagttgtttgaaatgaatgtcatgcaacagcccggcttcccgcgcattcagcttggcgatatcaatcattttaccgtcaatatcgtacccactaatatccagctcagtgtcgtaatcggctaaactatcagcttcgtctctcaattgttgactcaggccagcgggaacccagtcccacttttcgcacgcaaatgcgcggttgaaccccggggcaatgttgcgcgccagtaaagcggcttcgattggaatcgtccccgaaccacaaactggatcaacaaatggattatccggataccacttagctaacatcactaaggcagcggccatgttttcttttaagggtgcgccccccttttcgactcggtaaccccgtttgaataaactagagccagttgtatccagcgttaacaacacgtgatccttattaatagccacttctaatgggaacaaagcgcctgtctccggaaggtgcccgctccgatgataagtatcggctaactgattaacgatcgcctttttgacgatagattgcacgtcgggaacactgtggagtttagagttgcgcgatttaccttcaactggaaattcagcgtccatcggcaataactggtcccatggcaatgcgagggtcttttcaaacaactcatcgaacgtataagcatcaaattcaccaacgatgatcttgattcgatcagccgttcgtaaccacaagttggtccgcaaaatatctttgatcgttccgttaaatcgaacccggccattttcagtttgaacttgataccctaaatctcgtaattcacgccccactaatgcttcaattccgctagcggcggtggcaattaatctaaattcttgcatagtttcctcctgcgacgcctgttctgtaggcgcatcttgttgagtaaatatttccactaaattggtttcctcacctagtttagcataagttgctagtttgctaactgatcgaataaaaaaactgggacaaaagcgaacttttgtcccagtctcctgtctaaatgtaaattcctgtaggccatgttttgtacctagttaaagtacagggtctgttaactaggcggtaatcatctatctcgagattactaatctccccccacatttagttcagttccttatgtgaagcgcccctaccgtagtttgggttgcccgctcgtggggtttaccgcgttccaactcaaccgtttccaattgagtatcgtcactgtggcacttttcaggaatactcgggcatagccgaagccttagccgttttttccgccgttaccgataaatcggtaccccggcttattttttcaccgagcacgaacactacaagcatcgcagcttgtgcgagcatggaccttcctcagccgacataagccgaccgcgattacccagaatttacatcgaatcacaattatagacggtgtgattcattttgattattatctaattgggcaccaaagacatgacgttccaagttagacaaacgtttcagaatatccatattcgtcaccgtactagtcggttgagaagatggactggttgcaccgacagcgacttgcttggtaagctcgtcaaccttggcccgtaaccgttcattttcatctgaaagttgttggttatctttagtaaatgactcatagtccttaatgacattatctaagaagccgtccacgtcggcaggatcataaccccgcatctttggcttaaactctttttgaaggatgtctttgggagtaaaattacgtttagccatatttaaaaacacctcattgttattcgcgcgatacccattcggcatccgcattacttaaaacattgtagcagactttattcaaaattaaaaccattattctgtttttctgcatattcattggcactttcctgtaaccagtcgaagtcgatcagggtcaatgggtacggatgagtgtcactaaagttccgaatcaaatcatagtcatacgtgggtttcccggggttatctggatcatataccagagtggccgcatccgtatgggtaaccataaattcttggtaattttttaattgttgcggattttcatacggttgtttactgactggtgcatgaaaatcgacttgggccagcaaagtctgtaatttagcttggttattttcattccagcgcccaccaaattcaccatatggtaacatcattgccactttcaattctggatatgtctttttgagcgttaaccctacttccgctgtccactgttcaataccgagctgaccacccgttatcagccaatccataccatcctcgatctgcgtcgttaagtaattagttaacgcaaacttaataacttttagtttatcatcctgatcaccaaagacattcaactcgtaactccggtaaccactaagccacaaccggctcataaaaaagtctcctttctgtcactaaatcggtctaaatcagttaaaaactcacagatatttcacattccctattagttaatggtaaaatgtaacattattaggaggttgattaatgtgacgattcgctatccaaacggtcaagtttatcgccaacccggcccaactaaatcgaaatcttccaaatttgccaacgtcaattttggcgatcgtggaatgagcttggaacaagaaatcaatgatagtaacgcctattatcttgaaaataatatcgcagttattcataaaaagccaacgcccattcaaatcgttaaagtcgattatcccaaacgcagcgccgctgtaatccgcgaagcttattttaaacaagcttctactactgattataacggtgtctatcgggggaagtatttagattttgaggccaaggagaccaagaacaaaacggcttttccgctaaaaaactttcatgagcatcaaattaagcacatgcgccagtgcttagctcaaagcggaatctgttttgttatcattcggtttgcgagtttggggcgcctatttttgttaacagccagcgacttatttacttattgggatcatcaaggagatggtggtcgcaagtcaattccactgacggatattgaacatttagccgcggagctacattatcaaatcaatccacgcattccctatttggatgcgcttgatcatattattgatgagacctcatcaattcattaaaggagaacatcatggcaggtaacaatgaacagaactcacgggttgctcgcagaaaaagccaacctaaaccacctaagaaacactggtttcggcggattattttatccttagctgcactgtttgtcatcggggtactcgctggtctagcacttttcttctactatgcgcagacggcaccaacagtcaaacagagtgaccttgtcaatacggggaccgctaagatttatgaccagaacgacaagtatttgacctctttgggaactaacgaccacgaatacgttaagtctagtaatatcccatccacacttaagaatgccgtcgtctcaatcgaagatcgccgtttttacaagcataagggggtcgattattaccggattcttggggctgcagtcggcaacttaaaaggtagctcactcgggatgcaaggtgggagtaccttgaccatgcaactcgttaaacttgcggtcttttccaccagtacttcggatcgaaatttgaaagtcaaagcgcaggaagcctggattgcgcttaatcttgaaaaacattacagtaaatctcagattctggaattttacatcaataaggtctatatgggtaacgggatttatggtatggggactgccgccaagtattattacggtaagtcattaaaagatctgagccttagtcaactcgcactgctcgcaggtatgccgcaatcaccaacctactacgacccgacgacttatccatcatacgcaactagccgccgtaatctggtgctggaagcgatgtacgataacaaggtcatctccaagagtcaggaaactgctgctgaaaaagtcagtgtcaagacgggcttaactagttcgggacgttcaagcctagcgaagcatgaaaagacaaataaaatcttggatgcttacctgaacgaagtccgtcaagacctcctcaaaaaaggttataatttaaccgatggcgagaaagtttatacgaacattgacatggatgcccagaaacggctttatgacattgccaacacgtctcaatacgtcaactatcctaataatggaaaacagactttccaattaggggtatcggttgttgactcatacactggcaaggtctcagctatgattggtggtcggaaaaccggtaatgtcacgtacggaaccaaccgagctgtctggacatcacgctcaaacgcttcgacgatgaaaccgattctcgattatggaccagccattgaatatttgaattggccaacttacaagtcgttgtctgatacgaaatacaaatatcccgggactaacatttccgtgcatgactttgacaataattacttgggcaatatgacgatgcgtgaagcactggttcaatcacggaacatcccagcaattcgggccttacaagccgttggtaaaagccgagccaaaacctttgccaataaccttgggatgaacctcaaaaccgttaactatgccaacgggatcggtgctggtgtttccaccttacaagttgccggtgcctacgctgcgttcgccaacggtggtgtttatcataagccatactacatccgtaaagtgactacttctgatggcgttacgacatcgtatactagcactggtaagcgcgccatgaagaaatcaacggcatacatgattactgatatgctgaaaggggtcatcaatagttctactgggacggcgacaaccgctaagatcagcggcgtttaccaagctggtaagactggtactgacaactatgcttctcagtataaaaacaaagtaccatccgatgccgtcgttgactcatggatggccggttacacgaagaattattcggtcgccgtttggactggctatgataagtccaccgaagctggtggttatctagatacctccaacgaaaagatttcacaacaaatttatcgtgccatgatgaattaccttcaacagtattcaccaaactctgattggaccaagccaagctcagttggcacgactaagaagaacggtatcgaagaactttacgttgttggtcacctcttctccagtagtgaagcctcgtcaggaaccgctagttcagctagctctagttcaacaacaacgggtagttcaagcaccagcacagaagcaagtagtcgtagttcggaaagtagcagtagtagttccgaagctgcttcctcctcaagtagcgccgaaagttcatcttctgaatctagttcagaaagtagcagcagttcggaagcaagttcaagctccgaagcaagttccgaagcgacttcatcggaaacaccgaccgctgataccaataacacgactgaaggacaataagaatcacccaagaccactgaattcgattcagtggtctttttatttgaaacaaaataatttttgagcgcactaatctaaagcactcgaaagtgttgaaaaaaactagtatactaaagctactagctagtatttaagtttgtgggatcaacgtaattgccttgcgttggtcctttttatagtctacataagtggtgccttcatcaatcatgacgtagataattcgtaataatttatgagccagtgcgactagcgctttttgcgcggtcatgcgaccgtgcaatcgccaaaagtagtcttttaaaccggtttccttggactgtttggcggcaagcgccgcgcttaccatggctgatttgagataaacattgccatgtaagatatgagcaccatgtttgataccggcagattcataattccccggacagagaccggcccaagaagctaaatgatgagcatctggaaatggacttacatctgacccaacttcggcaatgattatctgagcaatccgttgactgataccaggaatgtcttgtaggcgaagatacaaatcattaaattccataatttgttcatcaatttgagcatccagttcagccaatacccgcctaaaatcagcgagtagttccatattcaagcccaacaatctccgatcgttgcgtggcagaatgccatccatcgcagcaaataattgttcaacactagcctttatgcgggtgtggcgacattttgtgatggcctgtaaagtgatgacttcaccatctatgagtaacttcagcagtttaaggccagttccgttaaaaatatcggaaatataggtcgttaatttaatgtttgagcgttgtaaaagattatggacttcatttttggttgcggtcatagattgggtaatcttcttacgtaacctagttgattcgcgtaatgcttgaatcgactttggcgggacaaaacttgcggaaactaagccgtaacgcgccaattcggatagccattcggaatccttttgatcagtttttttaccaggaatgtttttaacaattcgcgggttacacaggatcatcttgaaaccgaagggttccaagatttgccaaaccggtcgccaatactgaccggtactttccattagaacttgttcaacatggcgttgcttaagccattcaccgcaatctttaagccgacaagtaatggtttcaaaacgtttcgagattttcttaggcttggcgttagccaagcccaccaatatagaaactgtaatctgtttttgatggacatcaataccagcaacactttcagcaacgacttccataaaactcacctcctaataatcttgaaagcagtaccttcagtcattgagggttgaaattttatttacgtgtacgaaacgacaattgattaatctcatgaactgaaagccatcggttttttatacgggctaaagcgagcaccaataagcacacgatgaacacgaaaccgccttcgcagtcattataactgagaaggcggttgtttcatatcatgattacgagggtagagcgaagcggcgccctcagatagttttttatgtgcactattttaccgaaataacacacaaaatttacataaactaaactcaaaatcaacgttaacacggcgaattaccactacaatacaaagtaacttaataaactgagcaaaccaattaagacaaaggagttgcatatcgtggttgccattaagctacacgaattatccaaaagttttcaaggtccggtaatcaatcaactcagtctgacgattcctgatcaacaaatcacggcattaattggcccgtccggttccggcaaatcaacgctcttaaacatgattgcgggtctcacgacacctgacagtggtcaaatttcatttgataatcagcccatttttgacgccgcgacccattggaatcagccccctgcccagcggcacttggcgatggtttttcaagactttgccctgtggccgcacatgacggtccaagaaaatgtcgctttcgctttagaaaagcatctgaccaagccggaattgactgctcaagtcaactgggccctcgaacaagttagtctgattgacttccgacatcgttatccacgtgaactttcgggcgggcaacagcaacgggtcgcccttgcacgggcactagcgacccaaccggatttgattttattcgacgaagctttaagtgcgcttgaccccgaactgcgcacacggcttcaattagaaattcgcgccctgattcacgaccagcatctgacggccatctttgtaactcacgaccgtccagaagccttgcaagttgccgaccacctcgtattactgcaagggggcaacgtggtgcagacgggcacaccagcacagctgtaccaacagccaaaatctcaatttgtcgccaattttatgggcacccttaatcagatcaacgcgcaccaggccattcgcccggaatatgtcgcagtcagtcaaacgggtactcagcagcccacttaccaaggcttggtgcagcgttcaacctttatgggcgatcattttgatacttacgttcaagtcggcgcctatgattggcacgtcaagacccagctaccctataccactgcaccgatcacattaagcatcgatccacatcaaatactaactttttaggagttgactcacatgtctaaagcagcaattatcacattatccacgctcggcgtgctcgcaattggcacgtcgctttatgttaatcaacatcagaaaaaaacgttaaccgccaacgcgcaaaccagtcaacaagtcttaacagtatacgctgctggacctaaacccctttctgatcaaatcatccacggttttgaagccaaaactggcattaaagtcaaaagttttgacggcacgaccgggaaaattttaagtaaggtcaaggccgagcaaggcaatccccaagctgatgtgctgattttagcttcaatggccgctggcgtcgatttacaaaagaatggccagctattaacctatcagccttctcaagctaaacacctgaataaacaatttaaagatactagccaccagttgatcaattacagtgcttcggcagtcggcatcacctacaatacgcagcacatcaaatcggcaccgacagactggtctgacttgacaaccactccgtatcgcaatcaagtgaccattccggacccccaaacctctggttctagtttggacttcattaacgcttatcaaatgaaacacggtacgcaactacttaaagcccttcaagaaaacggtgccgatatcgggggtgctaacaaggaagtactcgatgcagtcatcactggccaaaaaatcgccgtctttggtggggtcgattacatgagtctaacagctattaaaaaaggcgaaaaaattggtttcgtttatcctaagagtgggactttggtcaatccacgaccggcgatgattttgaaggctagtcgtcatcaagccgctgccaaacaatttattgactatctcttatcagctaaagttcaaagacaaattcaaaaaagtaacttaattccaggtaccacgagcactttgaccgatccacgcaatggcgaagccatcaaagcctacacggtcaattggaccagtgccaacgcggccctgactaaaaacgttgtcgcattcaatcaggtctttagccaatgagtaatcatcaaatccgcttgtccttatcaatcatcaccagttgcttgttggcaactctgattatcggcccgttagtcgccctgattggtcaaacactagtcgggcaatcgccaagccagctatggtcacaactgatgcagccaaccaaccgtgtgagcattcaacacagtctgttcctcagtgggggcacggtcgtcgggacaaccctgctagccacccctttggcatggatcatgacgcacacccgtttaacaaagctcgcctggttgcattggctcttgttagtgccattcatgacaccaccatatattaacgcgatgggctggttatatttctttcaaccacacggattactggctcagcttaatccgagttggcaccaccaatttcagtggctattttcaccgttcgggatggtcattatcatgagtctgcatttgtatcccgtggcatacttaggcttacgcgcagccctcatgcaattcaaccagcgctggcttcaagtggccgaagttcatggggtcaacacctggcaacgactagtgcgaatcacattaccaatcatgttagtcccatacttagctgtatggattttagtctttaccaaaaccttggctgaatttggaacgccagccacctttggtcggagcatccacttcgaagttctgacgactacgattcaaaaggacctcagccagtggcccttagatttccaaaacggggtactcaccggcaccctcctactgaccattgccctgattgcctggggtatacagcaatggttgttacgccggccagctgttaagttcaccggacaacggtcagcgtcacaatatcggcagcttggagtgacaacattagcaggcactttcgtcaccctagtcatcagtattgctattgtcctgccattcagtgccatcgtgctccaatcgctactcaaacaacgcagtcttggttggagtccgtctaatttgacacttgtacactatatagacctcttacgctttgatagtcctgcctggcaggccattgttacgaccgtcggattggcattactgattagcagtctcaatgtgatcgttggtttattcttgagcgttgggagtttaacaaaacgttttcccaagtggctgcgacagttatgtcataccttgggcgcattgccactcgcaattccaaacgtcgtcttagcattgagcttaatgatgctcttttcacaggtgctggcgttcaccaaattatacggcaccctaaccatcctcctgatcgcggatgtcaccttatttctaccaacaacggtgcaatacttgacgaccgccctcaaggcctttgactcggaattgctggctagcgcgcgcatcttcgaacctagtttcggccgcattatcctaaaaattgcacttccgattctatggcccgcgctactcaacagctttgtgatggctttcattgccacgagtcgtgaattagtcgttgccctattgttactgccttccggtatgacgaccgtttcaacatttatctatcaatcgttcgaacaaggtgaagcggccgccggtatggccctagcggtattgacggtagcattgacattcattggactgattgcagctaatcacctgcaatcagctactaagccagtacgccagccaaactagcacccaaacggcatcagttggcactcaaatcggtaatcgtcagtaacggaaaacgactttgttttttcgtcatcgcctgtcccaaactaaaaaggctggccgcacgagcgtcaatgttgacgtcgtgtgaccagctttaatcatctctgacaagttatttagaatcgtcggccgaaacatcaccggtttgttcaacctcttcagcttcatcgctcggcatgttaacaacggtgacgttagcctccgtattacgaacaacatacgctgtcgttgaacctaagaacaggcgagaaatcgcattagtcccagagcgaccaatcacgatcaaatcaatattttgggccttgggaacatcgaccgcaattgtcactttgggtaccccagtttgccgaattgtttcggcgtgcaactggtgggctgcaacttgattctgggcccgctccaacaatttcttactctgggcttgatcaaaactcatcatatctggcgccgcactcgtaaaaacatctggactgtagacgccaaatcgattaacatcgatgacattcaataaaaataactgggagtcaaaaaccttcgctaaggcaatcgcatgttcaagtgcataataagcattatcggaaccatctaatgggactaggattcgtttatacatggttgagacctcctgataagttcaatgagttacaacatttattatcataatcataacttatctataatcatccagcatccaatatgcttattaattgtcaaaataagatagcggtttattgatgttaatcttagtaccgtaatatttttgcttgatatacttttgaatatccgcccgatggtaaagtttaactagtttaagatagctagcacgatgttcgttcttagcggccgttgctaagatattaacattatccctagtactcttattcagactttcgtggaaaatcgaatcccgtaaaacgtgtaaatgtccttccaaagcaaccgtattcgaaatcaaaactgcatcgacacttttaatgatccggggaccagtagtatcatcgatctgtttgaatttcagatgacggggattgcttgtaatatccttcactgaacctaagacaccaaaattagctgccagtttgatcaggcccgctttttggagcagtaacaagcctcgcgaagcttgtgagggattgtcagcaattgcaatcgtagcgccatccggaatttcatcaacgctttgatattttttggagtagattcccattggttccaaataagtcgttcctaacgccgccaacttggccttgggattctgctgattataagtttggtaatatgaccaggactgaaaggcgttcacatcaacgttaccgtccgccgtggccttgttcagctgaacaccatcagtgatttgtttaaccttaatcgttaagcccatctttttggcatcttggcttttagcaatgtgctgccagacttcatagtccgatcccattgatccgaccgtaatcgtggcactctgttgtgcacgggccgaataactcgttatttcatgtaatcccacacaaataccaacaattgcagcaataccaatcaaccaccatgctaatcgtttcatcggctaattccccctttattaatgatgtgtgacgctcttgacgagccaatcaccaaacagctgtacagcaaagactaaaatcaaaatgatgatcattgcgaaaaacgtcacgtcgttttcaaagcgggcgtaaccaatactgattgcaatatcacccaagccgcccgcgccgatcgcaccagccatcgtcgtcagaccaatcaggctaatcaccgtcacgattgagacgcgaatcaaatcaggtagtccctctttcaaataaacccgaaaaataattgcaatgggactagatcccatggactgagcagcctcaacgattccttggtcaacatcgagtaacgcattttgcacttgccgggcataaaaaggaaaaataccaaaaactagtgggactaacgatgccgtggtccccaccgttgttccgattaaatagctggtcaacggcgaaattacggccaacagaataataaatggcaccgaacggagtaagttggttagcttgtctaacacttgatacgaggggccatcagctaaaatgccatggggctgtgtcaccactaacagtacccctaaacccaaccccagtattcctgcaaccagcgcggaaactgcggtcatatagagggtctctaacgttgcttgaataaattcagctttcatttgtaagacattcggaattaatgctgtcattagtccaccattcccttcacaacttcttcattgataatgcgagtgtggacaccttgagccgacatattagtgaccgccacattgaaggccgttaaatcccccgtaataatcgcaatcatgtcaccaacattttgaccatcgatctggtcgatattggcaaacaaaatgttaacgtcgacccccagcgtctgcgataactgcgagacaattccctgctttgttgattgaccaacgaatttgaacgcaatcagctcttggtccgctgctaattcactcaatttaatcgttttcgtgattcgctgaatggcggcccgaacattggtagatgtttccacaaaatcaacggtcagaggtgctttgggggctgtaaaaacctcagcaacggggccccgctcaataatccgcccatcagccataacggcgacatgatgacaaatactcttgatgacttgcatttcatgcgtaatgaggacaatggtaatccctagctcgcgattgacccgttgtagcaactcaagaattgccgccgtggtctttggatcaagcgcactagttgcttcatcagaaatcaagatttgcgggtcagtgactagtgcccgtgcgattgccacccgttgtttctgcccaccagataatttatctgggtaggtctgcgcatagtccgttaacccaacgagcttcagtagccgtaatgctttggcgcgtcggtcctgtttactaattttttgacccaataatggataaataacgtttcccaacacggtccgtgattgcatcaagttgaagtgctgaaaaatcatcccaacgtgtttcctggcttgacgtaatgcagctggcgatagcgtttgtaaggcctggccattgacgactacctggcccgttgtcggtgactgtaataaattgatcacccgtaccaaggtacttttgccagcgccggaatatccaataatgccataaatatcccccgtctggatctgtagattgacatcttgaaccgcgtgaacgacttggtgcccgtcgtcaaaagtcactgcgatgtcttttaaatcaatgattgcctctgtcatagtctgcttcctcccattaaaaaacgcccatcgtctctaatctgattatcagattaaggacgaatggacgttttccgtgttaccaccttacttcaaatgaccctcacaggccaccgcacttcaagtaccgccactgaaaattcttagcgagactctaaccgcataacgggcgtagccgtcaacgcttaaccccgtcagctcagcgttgaaacttgcattataagaccatcttcaacgttgcgaaatggctacctcgcaccaaccggcagttctctaaggcattccaacaacggctactcatcttagacgtatttattaatatatttacttggttgtttacagtattgcgctattttaatgagaagtcaacatttaattataaccattttttaatttatagtggtgcccactgattttggtccaatgatgtgcatcccaccggcttaccaggacaggaaatcctggtggtcctgttttaacctcagtacgctgcgccaatgacgtgggcaaacgccattgatatgaaacaacgactaacccatcccgaaaaaaagtggtagcgacgcctcgcacaggcaatcgccaccactttatttaaaatcagttttccccgataagcttttcagcacagtgtttaagactggtcttcacctaatttgaataacggaatcttcggaccagcatttgcgcccgtctggcgttgtggttgcggagcggaattcaagcgttgctcaatactgcgttggcgctctgcttccacctgggcagccgtttttaagttacgcttctgccagttcaacagaattcggtccatatacgtcaagttatagacttgacgcagaactgcttcccgcaatgccaattcgataacttccggttcataatggtcttcgtcgaaccacttactaatactttccatttcgatcggtgataagtcacggccaaattccgtctgaattgcccgaaaaaccttttgccgactgttttcactcgtggcttgttccgaagcttgagtgctaactggctgctttttgagcgcaactgctaacttatcatacaggccgtcaaaattataacggtcatgaattttttggtcatcagccgtgatcgattcaatcgtcagcaattttttggctaacatttcatgtagccgctgaaaaacagcatttgtcgattcacctaaactcttggcaattaccgcagcatctgggaattgattaccctgatcaattaaccgtttgaactgcaaataaaccaataattcatcgtttgtgaccccaatttcacgatagtgggccaataatgcgttcgcaatggtcgtttgaccatcattcactaacgcggcagctaaggactccatctcgttatcatcctttcactattaagagcgtgagactaggtcccacgctcttaataaaactaaccttcaattaaagtttacgggtaaatccggttcaacaaccgtgggaacggaattgtctcccgcacgtgatcttcggccgtaatccaagtcaagaatcgctcgagtcccaaaccaaaaccagcatgaggaacactaccatacttacgtaaatctaagtaccaagcatagtcgtctggatttaagccggcttgtttgatctggtcaagtaagtaattgtaatcagttgctcgttctgacccgccaataatctcaccatagccttctggggctaataaatccgcacaaatcaccacgtcgtcccgggttggatgcggcttcatataaaatggcttgatggctttcgggtaattcaaaacgaagacgggttgatcgaagtgatcagccaagaaggtttcttctggtgaaccaaaatcaacaccccaatccacgtcaaagtcattttcttttaacaattcaatggcttcatcgtaactgattcgtggataaggtaacttggtgtacttcttcaacgtttcaacatcacgacctaaaatgtcgagtgcgtattgacaatgatcaatcacaccttgaacaagaaaggcaatataacgttcttgaacttccaaactttgttcttgatgcatgaaggccatttctggttcaatcatccagaactcaattaaatgccgccgagtcttggacttttcagcccggaatgttgggccaaaagtaaagacctttccgtaggccaaagctccggcttcggcgtataactgaccactctgtgataagtaggcatcccgatcaaaatattcagtatggaacaattcagttgtcccttcaggtgcactcccagtcaaaattggtgagtccatcttaatgaaaccttcttgattaaaaaattcatacgttccgcgaatgacttcattacgaatgttcatgattgcccatggccgcttagaacgtaaccatagatgccggtgatctagtaagaagtccaccccatgttccttaggcgtaattgggtattcttcactttcaccaacgactacaatgtcttcaacttcgatttcataaccgaactttgaacgactgtcttcatgaatcacacccgtaatccacatactggcttcttgcttaacttccttagcgagttcaaaaacttcttcgctaacttggctcttaacaacgacaccttggaaaaaggcggagccatcacgtaattgtaggaaggcaatcttaccacttgaacgtttattagtgagccaagccccaatctttactttttcgtcgacatggtccttagcatcgataatgttgatctgttgcaccatttacttacatcctccaattactttgcttgttcagcaattttttctgtcataaatttttgtaaccgtcgatgggcctctcgcaaggaatcgatatcagttgcatagcttaaccgtaaacaaccgggcatgccaaacgcctctccaggcactaaaccgacatgggcttctaataacactgccgtcacaaaggccggtgcatctgcatagcctgttaaacgcaatgcttccgtaatatctgggaacaagtaaaaggctcccgctggtttgccagcaggcatcttaaacccaggtaaacgctcgatcaatgggtatagttcgtttaaccgcgcttcaaagccctgacgcatcgtttcaacagatgattggtcaccactaaaagcttcaatcgcagcatattgtgatacggcggctgggttgctagcagcgtgacctaacacgacccccatcttagccatgatggtttgtggcccggcagcatatccgatacgccaaccagtcatggaataggcttttgaaaccccattgatcaaaaccacgtgatccatattagcatcatctaattctaacacggatgtaaattcattaccgttatataataacttttcataaatttcatccgcaattaccaaaacgtcgtgttcaacggcccaattcacgatcgccgtcaattctgcacggctgaaaaccagaccggatggattctgtggcgaattcaagactaaggccttcgtcttaggcgtccgctgcgcttccaaatcagcagtggtaaaccgcaactgttcatcggtgctaacttcgactggcacaccaccagctaatttaacttgctccgaatagctgacccagtatgggactggtaataacacttcatcgtcgggattcagaataacttggaataacgtaaacaacgccatttttgcgccatccgttacgacgatctgattaggatcaaaatggtagtgatggtcagcctcaattcgctgactgatggcttgttttaaagctggtaatccagttgccggtgtgtagaaactcgcttgaccattttgaatactatcaatggctgcttgcttaatgttatccggggtctgaaaatccggttcaccgattcctaaattgataacgtcaacgccgtccgccatcatttgcttggcagtcgcactgatcttcaatgtcgctgacggttgaacctgcattactttacgcgataattccatgtacatccgcactcctttaaccttaaatgttaataattgatttcagctggtttccattagaatactgcaaaatttcataacataaattctttttctggttcaagtacgtaatttcccacacgaccgtcccatcatacttcccaagcgtcgctttgataaccttgctaggattgcgtttagaccagacctttttcaaggctttcgtacgtgaaatcccagcggactgtttgataacggtcgttttatgatgtttattcgcgttaattaacgcgtataccggaacatttttactcgacgttcccgtaacgacgtaataactactggtgccattgtactgtgaaaaggccgtcgtggtctttagcttgcccttgctgacggccagactatacgccgtcttctgggcttggtgcattggccgttgtgcggcccataacgtgccatagaccgccacgataatagctaaaatgacgaccagaataatcataatgagtcgctcagggcgccttctacgttgaactcgcatatgctcttcctttcaaaaacagataaattaattatagcaaatttaactgattgcggaatggtttcttacttagttttgaaaaaactttgaagttcctgcgtaatcatcgtcaatgaaccggttgcgggcggcaacgttttcggtaaagctttaagaatcgtctgcccgtatcgtttcgtcatcaaacggtcatcgagaatcaccgctgcccctcggtcttcatccgtccgaatcaaccggccgattccctgacgtaacttcaatgccgctttcggtaacgcttcgttatagaacggattgagttgtgcttgccttagttgttgataacgggccttggttgtcgtctggtcgggcgattcaaacggtaattgcgtgacgatcaacaattccaactgttcttgtggcaagtcgatcccctcccagaaactaccggcacccaggagaatggcatcgtccccctgcataaagcgccgaagcagcttttcacgactaccattgacgccttgagccaaaatttcgcgatcaccaggtagatccgtttgatgcaaactgtaaaagactgcttcaatcatattcagtgaattgaacaagaccaacgtttgcttaggcgctgccatcacgatgtcgtgaatcgcatgcgtcaagtatgccacgcgctgcttgccactgggtgcttccgccgcagtagcatccgtagcgacgaatagccgtgcctggtgttctaaatcaaacggtgttgataatcggtgatgcttagccgttgcttggtcaatatccaattgcgaataaacgtactgagatttcccagtggcaaatagcgtggcaccagttaatagtggcgcactgaagtaaggatatagttgcgtcttaaaatacccttgcgtatcgatcaagctacccgcgagcgtgagactgccgcgatcatgccattgattaaggctcacccagaagacccgttgttcccgcgaagctggcactaaccacgtttgtaataactcatagccctgacgaagatgttgaagacgattgtcaaagtcgtcgaggacgtgttgttcactaggcaagatttgcgattgatcatgttgatactgctcatttaattgttgaaactgtaaaaaacagttttcaatggccgtttgtaattgtttgatcagcggattgtgggccgcaaagaaatcagtcaactgatccgtggtgattcctaattcagcaggctgattgccgcccttttgtgctggtacaaacgttctggctagcgccgcctgcagttgttgcaggtgtaggtcagtatcattcaatgaattatctaataatttcagacgataatcggcctgtggttgttccgcgaacagtgcccgtaaatttagactatgttccgtgtcaatgcgactgatcaagctgtggcaggtcgccatgtagccattgaaatcaaacgtctgccgtgagtcacgaacgacgccatctgccagatgctgggcctcatcaagaaccagcagtggccgctcttgacggctacccagttgggccacgtggcgcatcaggtaggcatgattggtaatgataaaagtcgcttgcgcggtcaattgatcccgaaagcgtaagaaatcttctttaaaaaacgggtcatcagctttcaacgaggccacgccatgatgggcgatttcgctaaagtacggcgcttgatacgtgctcaagtgcaattcatccagatcaccagtcgttgtcatcgtcaaccacactagcacgcgcaacttcaataattgcgtttgcttcgaatgttcatgcaacgccaagccacgggcaaaccggtttaaatcaacgtaatgctgattacccttaatcacaaccgccgtcacaggattaggcaacaactgattcaacaacgccacgccctgatcacgtaactgcgtctgtaagaccgtcgtcgccgtgctaacgaccacctgttgaccatcctgtgccaagtaggcaagtggcagcaaatacccgagtgttttacccgttccggtcggtgcttcaatcaacaatggtacttgttcagcagactgttttgagtagtgccgataaatctggttcatcatccgggcctgttgtggccgataagtcaagcgatcaccaaagatatgctgcttttgtgcttttgtcaacggatagcgtgccgctttacgacccgcggcttgctgtggcaatcgctgtttacgcagagcgagcccgtttttgatcactaagtcagttggtaactgctgtggatgttgtttgccctgttgaaaggcgtatgcaaacaagtcagccgtttcacgtggtaactccggtgctaattgcaccatttgttgtaacgtgatcaatggtaagtgtgcgagccgctgttgtaacgtgataaacaagtgggccgtagcaattgcatcactatccgcagaatgcggatgattatggtcaatcgcaagcaagtgactcaagtcccgcaaccgaaaactcgaagcagtcggtaacagaatttggctaagagacacagtgtcaacggcctgaattggtagttctggataaccgacacgctgcaattctgaattgataaatggcaggtcaaagttcacgttgtgggcgacaaaaacagtcccttgtaataagctgtataccgtaccagccagatcatcaaagggtggtgctttgcgcacccgtgcattgctgatccccgttaaattctcgataacggccggaaccgttgttaacggattaacgtccgtggcaaatgtattaattattttattattcttaacaaacgcgcaaccgatttgaataatccggtcgccgtccttcacactagttccagtagtttcaatatcaactaccgcataagttgtgtttggtttcatggtcatttccccaagttatggattgtaaagatgttcattagattggttaccgcttgaatccgtcatcaacactaacgctgatgttcgaccaactaatcgatctttatggcatatcacgtgcgatgtgtttgtaatcagactgaaggctggtccaagtagcgctacacttggtctcgaccactaactttaacggttcgtcggtcagcccaacttagctgagttcaacctactaaactgtgccagtgacacaagtcgtcctgatgacgcaagccgcttggctcatcctccacaccgatcgtcacacatacgtcacgtcgatcattgtaaattatagcatattcggcgtagggaactcagcccgaccaactcttaagccaaattcgtcagtctgaggacaacgggcagagactggtcaagagtatgattgagcaacgataaagttcatgaaagtgtctcggcgtacatctgccataacacagtcagctgagtacgcgcgcttgaatagccggcactgctacccaaaatttactttcctaattagtgaattctgggccacgtagtccgtcacaagcagctcaacttctttttcatcattatcggactgatttctaatcatttactaattttaacatagtaatcgatcttcgtctgccgttgataaccagtctgtccatacgcccctcacgtgaatgatttaatttaattaaattgttactttccaaaccagtttaacttacatttcaactgaattcagcgcgttcgccggggttagcatggcaaaagaagtgctaataaggtattatgaagctattattaatctacttacagaaaggcagcgacacgattgaaagatctagctaccggtactagtcatgccaaaattattttaattggcgagcatggtgtggtttacggacaacccgccattgccttaccgatttcgaccatccaaatgcaggccattattcaccgccgtgatgcagcgcagacggtcaaaagccgttacttcaacggcgactttaagatgatgtctgccaacttaggcggtattcagacgctcattagaaccttgcttgcacgttttgatgcccccgagcagggcttcgatattcacatcacgagcgatattccctctgaacgcggaatggggtcctcagccgcagcggccgtggccgtaacgcgggctttttatgatttcttcgaccgaccactctcccaccaagaattattggccactgccaatgtggcggaaagttacacgcatggtcaacccagcggcctagacgttgcgacggccagtgccaaaagtcccgtctggtttgtcaagggtcgtgagaactttccgattccggtaaagcttcccggctatttagtcatcgcggacacgggtattaaaagtcagaccaaagttgcagtggcgaccgttcgcaacttactaatggttgagggcgcgacgattcaagcacgcattgatgacttgggccgattgactcgtcagacccgaaccgcgcttgaagatggtgacatgggggccctggcaacagccctaaatggtgcgcaagatgacttacgttccatgggtgtcagtcatcctgcccttgaacaactactcgcagtggctcgccaaaatggtgcgctcgctgccaaattaaccggtagtggtcagggcggttgcttgattgcgctcgctccggaagccagcatcgccaaccaattatcacaaaaattggccgcagccggtgcgactgcgacttgggtcgaaccacttttatgcgatgactaattttaattttggaggaaaagacatagtgaaaaccgttacggcaaaggcccatactaacattgcgttagttaaatattgggggaaaaaagatgcggcgctaatgctaccacaaaatgggagtatttcgctgacccttgatcacttctatacccagaccagtgtgacctttgatgagcatctcgatactgaccaaatttactttaaccatcaacacttacccacgggcaaatcagcacgaatcagccagttcctcgaccttattcgccagcgcagtggtcaaaccaactatgcaacggtcaaaactgaaaatcatgtgccgacctcagctggcttagcctcttccgcctccggattcgcggccttagcaggggctgctagtcgtgcggctggcttacaactagatgcggctgatctatcacgactagcacgccgtggctcaggttctgcgacccgctcaatttttggcggttttgtcgaatggcatgccggccatgatgatcagagttcttacgcggaagtcttacaagacccggtcgattgggacattcaaatgatcgccgttgttttgaaggccaccaaaaagccaatcagctcaacggacggcatggcacgggtcgtcgcgacatccccctactatccagcttggatcaccacggctgagacggacttgaagcgaatgcgccaagccattgccgatcgtgatctcactactgttggccaaattgctgaaacgaacgcaatgcgaatgcacgcgcttaatttgagcgctgagcccgcctttaactacttcactgcggatacactgacggccattcaagcagtcaacgacttgcgttcacacgggataaactgttattatactttggacgctggcccaaacgtcaaaatcatttgtgcgggtcaagataccgacaccattatgaccgggttacaacaacattttgacgctgatcaattaatcgtcgctaaaccaggtccaggtatcacgataacggaaaaataattcagtttaatttaaaatgatcagcgatggtcatgaaaggatatgatggcatgataacggtgaaagcccctggaaaactctacattgccggtgaatacgccgtagtggaaagtggttatccagcaattattgttgcactagatcaatttgtgacggcaacgatttcacctagcgaaacgattgggagcatcgtttctgagcagtatcaagaaaactcaatcgtctggcgacgtcagggagacgcgatggtttttgataatcgtgacaatcccttccattatattttagcagcgatcaatctcactgaaagttatgcccatgaattagggcgtgaacttggtgtttatcatctcggtatcaatagcgaactcgatagtgctgatggtaaaaaatacggtctcggctcttcagcagcagtgaccgtggcaaccgtcaaagcactatgtcagttttaccatttaccgatggataaaaataaactgttcaaattagccgcgattgcccatctatccgtgcaaggcaatggttcgcttggtgacattgctgccagcgtctatggtggctggatcgcctaccattcattcgatcggcaatggttacacctacaacaagctcagtcaagcttaagtgatttgttaacaatgccgtggcccgacctaaaaatcgagttactgacccctccagcagccttacgtttgatgattggttggacgggttcaccggcctccacatcacacttagtcgataaagtggccttagtcaaggcgaagcaacgcagcgaataccagacctttctaaaagccagcaaagcttgtctaaaacgtatgatcactggttttcatcacagtgacttgcacgtgattcaaaccgagttgcgaacgaatcgtcaactacttcaaaaattgggcgatttcagtcacgtgacgattgaaacacccctgctgcagcgtatgattcaactcgccgaaagtgctggcgcggccgcaaagacttcgggcgctggtggtggtgactgtgggatcgttttgattgatcaaaccatcgacccacgaccattattagctgcgtgggctcacgatggtatcgaacaacttaacttaaacgtgcatacggttcaggataccgttttaccaaattcttaagcagtttattgacgagcctggcagccttgccggactcgttttcagattctaaattaattggaggtggcaccgtgccacaaagtcaacaatctcatcggaaagatgaacatgtttcgttagctgaaaagtattttcatggcgaacaagccaatgcctttgaccaggtccggattcgccacgacgcgttgccggaaactgccgtggacgacgtcgatttagccaccaccgttggccagtggcattgggacagccccctctacattgaagcgatgactgggggctcacagcgaacgggcgaaatcaacgctcgtttaggccgcatcgctgcagcttgtggcttaccgattgcgaccggctctcaaagtgtcgccatcaaagatccccaagtagcccccacttttgccacgatgcgtgaccacaatccgaacgggctgatctttggcaatcttggtgccggccacccgttatctgcggcccaaacagcgattgcaatgctccaggccgatgcgctcgagctccatctcaatgtcgttcaagaaatcgtcatgccagaaggcgatcgtgactttcattggctaactaacatttcggacttagtccaagccttaacggtaccagtgatcgtcaaagaagtgggctttggtatttcccgccccacgatgcaacagctctacgctgccggcgtacgctacctagatttaggcggtcacggtgggactaactttgtcgacattgagaatcgccgacgtgctaaccgcgatatggcctaccttcacgactttggcctcaccacggttgagtccttgctaggcgttcagaaccgaccggatgatctcacggtcttagctgctggtggcgttcgacagccactcgacatcttaaaagcgttgatgttaggcgctgacgcggtcggcatggctggcaccgtgctacacgctttactccatcatacggacgacgaagtcattgcgatgctgacggattggcagtcgcaattaaaacgcctatttgcactcgtcggcgtaacgcgtgttgatcaattcaaaagtagccgtattcaggacaagattctgttatcacctgaacttgttaactacaagcaatcgattaaagattaaaacaaagcgtgtcatcacaaactacggaatgtcattctatacttgtgatgacgcgtttttgttataaccaagtacaccaaaaaaacagtgtgcccctatggcaagcactgctttttgatcgtggtaaagaaaataatttccatcatctattgattgctattttgacacgtattggtagcggttcacgtacgtccgtggctgaccagcccgtagaacaacatcgccaaagccatgatgattaatagcatccggcaaggtttgcaattccacggccagcgcatggtagtcccctaaacgatacgactgcgttcgttcgggattagcggtaaagataactaaaccattgcgatccgtgttgatgagcagtcgcccgtgagtcgttgccaacacgccagcgggttcatcctggtggtcaagcacatagcaatcatcgtattccgtcctgccagtttcttggatcaatcgatcgagctgcgattgaatcgttggctgctcacgaaagtcatacgctggtgacgggacgtagaagacgccggtcggaaccttctcgtgattcgtatgaactagcttggtcgagttgatacgtaattgctggggattaatcagtgcggcctgaccatcaagattaaagtaaacgtgacaggtcggattgaataacgtatcagcagtggtcaccccgtgatagctgatttgaacctcatcatcggccgttaacgtatagcttacagttaccgtcaagtcgcctggaaaaccatcgtcagcgctcgctagcgttgtcgtcaatgtgacagtgtcgccatcaggatcaaaacgagctcgaaaattatgcgtttgtaagccatgattgccaccgtgtagcaaatgccggccgttatttggttgtaagtgatacgtctgcccattcaaggaaaacgtcgcgttaccgattcggccagcaactcgacccactgttttgccgacttgataaggcgtctcgatataatccgccaagttatcaaagtgaagcactaatgagtgtggctggcggtcgacctgcacttcgaagtcataccacgttgccgcataactcaacacttttagtttgctatgatggatattttcaatcgtgtataaatagactgactcgccttgatacacaccaaatggtactgcagaaatcgtacgcctcattcccttcgatcagtgcggattgaactagttctgtgtcaatgtttgcgtggtaccatccacttgaacatcaatcggttccccagcaatcaacttcaaagtcgtcccatcgtgatcaaccgtgacttcaataatccgatcacggaagacctgacggaaagaatacttcgtccattgttttggtaagaacggccggtaactcagttgtccatcatgaacacgcatgccagcaaatccttggaccatcgcaatccaaccaccagtcattgaggtgatgtgaagaccgtcgaccgtatcattattgtaattgtcaagatcaagccgtgccgtccggttatagaaagccacagccttgtcttcatagtgtaagtcagcagctaacacggcatggatggctggtgacaagcttgattcgtgaaccgtcatcggttcgtagaaatcaaaattgtgtttcaattgtgtctttgagaaatcatcaataaagtcatacatcacttgtaacacatcaccttgcttgatataaggtgaccgtaagatgtggtcccatgaccaatgctgattaattggtaactggtcagctggaattgcggaaacgggcgctaaatccttatccagataaccatcatgttgaacaaagatatccagatccttgtcatatggtaaatacatccgatcaacgatatcttgccagtgggcacgttcttcagcagtcacgtttaaggccgctgcttggtcgtcactaacctgatctaaaatttcaagcgtgtacttcaacgtccattgcgccaaataattggtattaaagttattatcaacgttgttttcatattcatctgggccagtgaccccatgaatcatgtactgctgattacgtttgctgaagtgcacccggtctgcccagaaacgagaaatctccgtcaacactttactgccttcatgtaagacgtatgatgtatcaccggtataacgcgtgtagttataaatagcaaaggcaatgtcgccgttacgatggatttcctcgaaagtgatttcccactcgttgtggcattcaatcccattgaaggtcaccattgggaacaatgccccatcaagcccttgttgacgagcattatgataggcaccatccaactgcttataacgatacatcagtaagttgcgggtaacttctggtttggtaatccccaggtaaactggaacggcaaatgcttccgtatcccaataagtcgcaccaccatacttttcaccagtaaagccctttggtccaatattcaaccgtggatcatcaccataataagtactaaagagttcaaacaaattgaaacgcatgccttgttgggcctcggtatcgccttcaatttgaatatctgattgttgccaccgatcggcccagcccgcttcatgggccgccaataaatcatcgaaagattgggcgctgaccgtatctgtcagacgttgaagtgcagtcataatggcatcatcagtcggataatcccgcgacgtaaccacgacgacccgcttttcaaaactaacgctggccccagcttctaacgtaccgaagtagcgatcaaccgtggctgtatcagtcacttcggccgctttatgggttaaactcgttacataactaacttgcatcccagaggtaaactgtggggtcccaaaatcatttggtaccgtctgagcaattaaccgatcatccgtaacttcgtggacgttccagaaatgttcatcgtagttcgcatcttcgttcttaacgtcagcatccagtgcggaagcaacttttaattccaccgcttgatcgctcaagttttcaaacgtcaccttctgaaccgaaagttctttttgcgcaacactcaagaaacgctcaaaggtcacgcgaacccgttgaccatcttgatcaacgataaatgatcgtgtcaaagtcccgtgttgcatatccaagtcaagtttaaaatcactgaagttggcagttgccaagtcgatcttagtcccattgagtttgaaattgattttgatgaaattgacggcgttgataaccttgccaaagtattctggatagccattcttccaccagccaacccgggtcttgtctggataccagacaccgccaagataaataccgggaagcgtatccccagtataatcttcttcaaagaagccgcgcatgcccatgtaaccatttcctagactagtcattgattcttgcagccgtttgttttctggtttgaaatcagtcgtcaagacatgccatggattaacatcaaaaattcgtttcataagttaattcctcctagtttttgtacgtttctttgatcaaaccaactgtgcccgcacctactgcaaggacgatcccagcaaagatgaacatgttggcttgtgaattgccaaataatggatataatgcaaagctcaataaggacgcaacaatttgtggcaggcagattgagccgttaaagagacccaagtaagtccccatgtgttcgccagataaggcgttggttaccatcgtcaatggatacgtattcattgcggcccaggccatcccaaccagaataaatgagacgacaagtgctgattgactgtgaatgaagaaaattgagaagaagccaattgcaccaagtaataaactcaaagcataaccaagtttatgccgattattcggaaccttggctaaaacatatgaccaaacaaccgcggcaacggactgaacagcagataagatcccgtaccagttaccagcggcttggtagcctgcagaactggcattagtggtgtgccaaacgttggcagccattgcaccggttgagtatgtccataagtattgaaatgccatccagcagaagaattgaactaaggctactaaccagaaaacctttggtgctttcttcaagagtgccaaccagttaccaccagatttattagcgctttcatcaatgccgtgatacttcgcgtaagttacgggatcatattcccgcacccgggcaatcgtgataatcgttgaaaccactaagattgctgctccaatataaaatgaccagatcactgaattgggaataacacctttactagccgtattggcgaccccgaacaaggtcaacaggaatgggaagattgccgcaatgacggcaccagtattcaacaagaagctttgaatcccataggcgtaactcttttggtcatcgttgaccatatccccgaccatcatcttgaaaggttgcattgcgacgttagacgataaatcaagaaatgccacggtaatcgcaccaaaaactaaggccgccatggaagcgtaaccaaatccaaacgagccagaattgggtagtagtaacatcacgattgccgcaacgactgttcccagaatcaagtaaggtaaccgtcgcccgcctaaacgtggggcccatgttcggtcggataaactcccaatgatcggttgaacgatcaaaccagcaaggggtggcaagatgaaaaaccagccaaggttatttggatccgcgcctaaagtttggaagatccggctcatctgtgagctctgaagtgtaaatgccatttgaacaccgagaaagcctagactcatcatccaaatcttattggatgacagtttcggtaatccggccgttgttttagatgtttctttcacaataaagcctcccaaaaataatatcaatcgcttgagtacaagttagattataaaaccgcttccaaaattatgcaagcgtttgcgtgaaattgcatgaaggcgttttacttattgacatccgtgcctatttggcatgaaatcggctaatatcaagggttcaaatagtattagctgatacatcgattcatataaaattcacatataattcataaaaaagtcattatattgcatgctgttgcatgaacaaatagatgcagacgctgaaacgttgcgtgtcgttgcactaataaaccgctccagccgacggatatcattttgtaaataaataataattttcaataatcgattgtaaatcagcatcgctttccattacccgacactaattattcagctttaaagcgccaatacgccattttctgtcgaatattggcgcaaaaaaatcgtgtgttcaggccgacttagcataaacacacgattccgaataattcagttattaatccgcattggcaatctttgcaaagccatcttgtaaatccgtattttgtgaactagtgaagttaaacgttgtggcagtggcactgtcttgcgagaccagaacgtctggcgagccattatggaaaacatacagatacgtaatcacgccactagacgcgttcggatcagtggccgcggcaacgacttggtacttcgcatcggtatcagcagccgtcgtccacttgagcttgactgtgtcaccattgaccgtaatcttatcttggtactgatggtttttgatgtctgaaggtaaattcaactcaccaatagttaccgactgaccatcataagtcccctcgtacgattggttcatggtatcttgccatgacgacataaacgaggctaactcgctcgacttggttgtcgaccacaatgccgtctgagttgccgtactagcagatgccttggacgatgatgacgactcggctttttccgatgtagcagtgcgcaacgaagacttggccgttgttgttaccgtcgaattactctgacgctggtatcccagccagtaatagccaccaccaagtgccacggctaataccacgatcaaaataacccaagacagttttgacgttgaacgtggttgcgcattttgacgcacatgttgcgctgaacgggtgctaagttcaggtgcagtcggtgcagccgaaatcgatgtactggcgctcggtgcttctgaagcagccgttgacgacgtggattgagcagcagaacttacagctgacgccggtgttggttgcgctgaactggctgggataatcagccgcgcaccacaattttcacaaaataacgcgtcaatatcattctttttcccacaatttgggcaatacataaactcttcctccaatatcacgattgattgggtccatttgaccagcaacttgagtagatcgttcccccgattttaccacggatcgaatgattcataacggccgctgctcatcacctgttcagcgtcaatcgcacgcggacgttatgacttagtcaatatcatatcaggttagagcgtcgcgttttcagaggtcgccaagaaccgtaagcccttaggaaagaaatttttaaccgtcttggcgacgatttttccaaacccaactggcaacccatcacaagttaagacccgaaaaccagctacaggcgcacttgtcaattcaaatgtctcaccatggacatacaatgcccactgttcacgcgttatttcagttttgggtaaggacaaatcatcactcgctaaggctaacgcgtaacttggttcaaaccgtttcttcttaaacgctcccaataaaatcccggggcgaaagaccttgagctttcgcgtaacgggcatcatcgctggcacgccgtataactgatcaccatgtgcctgtaacacgagctgtggtaaaccggccattgcttgtttttttaaaaagtccgtccatagctgccgttgcgtggcgtttaactgttcgcgaaccacttttttgtccttgcccaccgtcgtgccatgatagaccaatttggcaataaagtgaccctcaccgcgcatcaagtgcggaaataaccgggccgctttagccagttcaggattgccatccgcccattccggctttgcatcgaccatcccagccgtcttggccagtggctccagctcaaactcaggataagtttttaacagccaggccatcatctgttcgtcctcttccggtgcaaaggtacaggtcgaataaatcaaatgtccacccggacgcaacatcttgaccgcttccgtcaaaatctcccgttggcgttcagcacacgccgctggatagtcgggcgtccaatactgaactgcgtcatgatccttacgaaacatcccttcacccgaacacggcgcatccaccaagatccggtcaaaaaagcctggcaattccttggcaagggcggcgggtgtatcgttggtaatcactgtattgcgggcgccgtagcgttccacattatcgccaagggcggtcacccgttgccgattgatctcatttgtcacgagtagaccagtctgatgcaaatagcttaacagatgcgtcgttttgccacccggtgccgcacataagtctaacactcgttcaccaggttctggttttgcaaactcgccaacggtcatggcacttggttcttgactgtagacggcaccagccaagtgttccagcgcattaccgttcaccttgccataatacccaattgggctatacggaacgggtgctgtcatcttggcgcgcatcgtggccgtcacagtcttgttcggattaacccgaaaccctttttcaacagggccatcgaaagctgccaaaaaagcgggcgcttgatcgcctagtagtcgttgatatttttgaataaattctgctggtaattgcacccaaatttcctcctcaattaaaaagcatcctcaattagattaccacattttgccccgactgtaaggtagcaaagattcgcaattaggtgggatttatgctaaattaaattaattaactgccggaaatatgggagatgtttgttgaatatggaaagaaaactaattgcgttagacttagacggaaccactttgaatgctgaatccaaactcaattcagcgacgatccaaacgatgcaacgactacaagcagcgggtcacattgttagcattattactggtcgctcatatcagggctcacaagcgatctatgaccagctgcgtctcaaaagcccaatgatcaactttaacggttctctgggccatttacctcaccaaacatgggcctcagaatatcagttcacaatcaacaaagcgattgtcttagcactcgttaaatatcgcgaacaattggggatcaatgaaattattgcagaaaataaaaacagtaccatgacagcgggtcaagatttgattgctggtcaattcttcccagagattgctgacagcccccgacttacaccagatacgttgactcgtaatccgaattccctcgtcttgctagtccagcttgatcggcgggctgccatcattgactggatcactgaacgctttggcgatcaagttgacgttggtgtttggggcggcccgaatgccatcctcgagattacctccaaaggcgtccacaaagccaagggtgtcgcctacttagcggattactttcaaatttcacggcgcaatatcatcgcctttggtgacgaacataacgacctcgagatgttagcatacgcgggtctcggtgtggcaatggccaatggtactgacaagatcaaagcaacggctgacgatgtaacggcctataataatgatcaaaacggtgttgctcgttacttgaacgattattttgcgattgcggaataatcgttcagatgcaagtagtcgacagttgtatcttaagttgctgactgcgcatcactattaattttcggactttacactagctcgtaatcaccactcaaaaatggcacttccagataaaattcaattctggaagtgccattttagttgttgttcaactatcaagggattgcgttagctaagttcagtcacgctcttcaacggtcgaatcagccaccttcgaagctgatttagccgcagtatcagtcttagacagacgtttttcagccaaatatgagtgacgcataccatagctaaagtagatcactaagccgacgatgaaccacacgcccgcgtataattttgcctggatatctaagcccataaaaacgaacagtgcgcctagaaaggcaatagctggtaaaactggatagaacggcatcttaaaggctggtaccgcaatatcaacaccttcacgacgccgcaaagcatagattcccagcgagacaaacatgaaggcaatcagggttcccgctgaaatcaattgagccagaaaagcaaacgggcaaaacgccccaatgataatagcaacgattgttaacacaagtagcgcgttgttaggttgattatgatgtaacttgccaagccacttaggtaacataccatcacgcccaaaggaataaattagccgtgaccctgctaaagtcatcccaatcagcgcagtgaacattcccagcacggcaatggcctgaataacactggcaacaatcggatggccagcttgtcgtaatgcccagccgactggttcggcgttattagcatatgatgaatatttgaacataccgactaagaccaaagcaacagccacaaagagcaccaccgcaatgacgagtgaaccaagaattcctcgtggcattgttttgccaggattcttagcttctgctgaattagcggcaatcgaatcaaacccaatataagctaagaaaatcatcgataccccggcataaattccttgccagcccccaaaagcactaccatcagcgtttaaatggtacttggggataaacgggacgtagttttgcacgtggatcgccgtcgcacccacgacgataaacgtgagtacggctaacactttcaacaccactaacacgttttcgacccgggaggccttactgattccacgtgagagcagtaacgagaccagcgcaatcaccaagacggcaatcaggtcgaccacgccaccatcagtcccaaacgtatttgacaaagccttcggtagagttagtcctaatggtgacaagagcccccgcagattggcggacagtcctgaaccgacgaatgccaacgcaataaagtactccgcaagcaacgcccaaccagcgatccaaccaaagaattcaccgaacattacgttgatccacgaataagcggaaccggcaaacggcatcgccgccgccatttcagcataagcaaatgcaaccaggccggcaacgatggctgcgacgatgaatgagaagactaccgcagggcccgcatggttcgcagccaccactccgggtaatgtgaaaattgacgttgaaacaatcgtccccacccctaaagccaagaagtccttgaccgtcaatactcgagctaggtgagaatctttgtcttcatatatgcttggatcttcctttaaagttaaccgttttaataaccgttgcatcaaaatcctccttattttaccaaccaatcttgcctcggggccgtttaaccagaccctgttcagcagcagccattgcctcatctaatacggttaacgcagtatctaattgcgtcttcgtgatgactagtggtggttggaaccgcaaaatatttcctttgagcgttatcatgacgacaccccgttcaaaagcggcataaatgacgtcactggcaaaatcaggatcaggttgctgactctgccggtctgtcaccaattcaatgcccccgttcagcccgtacatccgtacctgcccaattttaggatggcgttgttgaagcgctaaaaactgttccttggcatagcggccataattggcggaacgggcaaccaactgttcatctgctagaacgtcgattgtcgccagcgccgccgcacaacaaaccggattggccgccgtcgtaaaggtgtgcgccggcgctgctagactctccatcacttcacggcgaccgatcactgcactaagtggtaatcccgaagccagtgatttgccaacggacattaagtccgggcggattcccgggaagttttgaatgctccacatcttcccggttcgtcccatcccttgattgacctcgtcgacggcaaataagataccgtgctggtgacaaaagtcatagactaattggacatactctgctggtgccttgcggataccgccatcaccttgaatcggttcaataatgacgcacgcggtttcctccgctggtaagtatgagtcaaatggtgccttgaacgcttcaaaatagcgtaatgcaagttcatgttccgtctcatgcggcaacgtacgataacaatcaggatacgggacgtgcacgatcccaggtagcaacggtcccatcttacggaccatattcaggctaactcctgagagtgacattgagccatacgttgaaccatgataggcatccgtataggcgactatgtattgtcggttagtataggcccgtgcaaatttaataatggcatcattggcatccgaaccagagttaccaaaaaccacctcattatcagtgccgggagctgattttgccagtcgctcagccaatcgttgttccggttgatgatgaaaatatgctggcgtgtaatgaatcaacttggctgcctgttcctgaatggccttaacaacgcgagggtgcgtatggcccacgttaatggccgaagcactggctaacaaatcgatgtattggttgccatcaacatcggtaagcagggccccgtgagcatggtcaataactaaatcatagtaattgattcgtgccgccgtcgccatataatggtcttcacgttcaataagttgctgatccaaacgatggttttgactaatcattcgcaagcctccattaatttaataagacttattttaatcatattttaatttctatgcaagtccttgcgcccatatttttgtttacaactacccgtctttaccagcatagccctagctttagcgctaatcaattttttaattaataagatgtaaattaaaaaaatcaccggttcattcaaccaattgctaacagcgaatcaacaagctgggatcattttaaattgtgaacgcgaccaccaaacttgccttgctggtcgccatcattttcctcagctcacctgctgcgcgcgaggtccgtggcgtgctagtgcacgttgggaatggatacgcgctcccacattgaacgacaccgctcagtgccacataagcggtacgaaaaaacgattatcatccgccccctatcaagggtcagacaacaatcgtttgtttactcagtctcacttggccttaggttttaagtaagcggctaggccccaacagactagccctaagacggtcgttgccaccagcaaacgcaagctttctagattcagcccccgtacggaccaaggatggtaagtttgcatcatagtcggcaccgtggcggcctgcgctaactcgcacccggtcagccaacccgtaaaactcgcaatgatgattgccaacacgcggcaacgtgttaacgatctgattccgtcgtacttgacttgtaactgatagcgtgttttcatcgaaaaatcacttcctcgtgaattcgcgacctcgcggcaatttgattagcctgaatataacacgtgagcatcgtgccccccaaccgtcaagtaccattcacaaagtatctttacagtaagtaactgtcatcacgccgctttacattgtgaatgtaatcgtcgtcccccgggtcatcacgggctgctcgggtgctggtaacattcccgcttgaccagctttaagccgctgagctgctaagtgcgtaacggccgcatactgagtcgttgtgattggcaccgagcagattcgctttgttcgtgactgctcaaattgataccactgtgcggcacgtaatggcactggatgccgctgtaaatcccccacatgaattttaaacgttgattgacgggtcacaattggggctggtagccagacccaccgtgttattgcttgtcccatctcaccaccaccgtttcgaatttgttaccgttattatagcatagcaaaacggaccgctgcgccccattaagggcatccaacggtccgaaaattcaatgttgttttttgtagcctgatttttctaaacgtttaacttgattttgtaaatgatcgaccttcgtcgtcaacgtgtcaattttaatcagtagttgtcgcagctcgtcatcatgctgtggttcctcgatcgtgacattctgactggcttgcgttgtgaagaagtcagtaatcgtactcgttaacaaaccaataaaaccaattccaccgaacatcagcccgaccgcgatcactttgccaacggcagtatggggcgtatcgtcaccataacccacggtagtcgccgttgtgatggcccaccacagtgaatctgacaggctttgatgctcgaaaacggaaaagagcaacgcactaagaacaataatcgcaatactaattgaaaacaggtagataaacccggtgctatagataaagcggtgaaaatcgtgcgtccacttaccatccagtccgagcttccagaacaaatggtgatattggaccatccgtgccaaacgcccaagtcgaaagagtgcaaacaccgggtgcatgggaataatccccatcaaatcgaacgctgaatgaatgagaaaagtcttccgatctcgagaacgaattaggcgcacaaagtagtccaccgcaaacatgactaataagccgttactgatgcgggtttcaacgtgccaatcaccgatatgaaacgataataggatcacgttaactgctgaccagagtgtcaaaagtgtgacaattaagtgatacaccgcaattcttcgttgctgtcgctgttctgtttccatcctgcttacccctattttataaactggtaataatatagtccactttcataaaaataaccacgataagtgcgaaaaattaagtgagctttactaattcgttacaaccaagtccctaaaacaaatagcactgggtatagaatgaagaacagcgaggcactcttgaccgtcgtaataaacgtcttctttttatcttgcacctcaaagaacgggcgcataccttgccacataattggtagtaagagtacgacccaaatcgtaacaatgggtgctagtcccagtaagacgttcacgagcggccaaatgccaccaataactaaaaacgcttgaatcagccgtaccgaacctggtttaccaaggtagtaggccaaggtgtagcgatgattcaaaatatcttcatcacggtccgctgtgttattagccagttgtaggcaaaagaaaatcagggtcagtggtaaacatagtaagaaagtcgttccaacgatcgaccaagtcaacggatgctgtccatacgtcgatacgaccacacaggtcaattcaattaaaaatgcaattgctaacgccacgaccgtctcacacagcggggtcgcgttgattggatagggcccagctgtgtaaaaaataccaatcacatagccaaccaatccaaggacgagcactaaccacccagtccgcatgacaagccagattccgggaatcaatgaaatcaggtacaatcccaatgctaagcggccgacacccgctacgggtaactgcaagcgaccaatcggattcgtcttctgcgcatagccttcccgatcacgagcatgccgataatcataataattatcagaaacattgacggctaaatcaaaaataaatacgctaactaaacacagcgtcacgttaagccaattcaccgtacctaagtgatactgcgcaatggcgcttccgagaacaaaccacatgatattaagtggtgccgtataaatttctgtcagctcatagaatactggccaagttagccattttttaaacattttaacaactcccccaccggttatttaaatcgttaattatctattgggaccttattgaccatcgtcaccgtcgaagactttaactatcaaattttaacaaacttcacgcctaacgcaagcaaagcggatagatttaacaaaaaaattagggccagtatgcaaccggtcacttggaaatcccacgccacatgctggcacccctgctagccatcttcagaccagcgtaatgacttcatagcagccattaacatccttcaatgataagtataccgtaactaataaattcatactgcccattttagcactgatcctagtcaaacgttgccacaagcccttcgacgacagcagcagacctaaaaaagcatttcaagagcctaactcttgaaatgcttttgggtgactaatctacttggttttctccggcactgagagtgggaggtccagccgtgttaagtcagcatagctttcacgctgcacaacaagttgactatgtccctgttcacaaaaaacaacggcaggtcgtggattccgattgtagttgctagccatcgaataaccgtatgcaccggtatctaggaccgctaacacgtcgcctggtgcagtggccggtaattgctgattccagatcaacatatcacctgactcacagtatttaccagcaatcgaggctacctgttcagctggtaaggccggattcttggctaataccgcttcatacttggcctgatataaagctggccgaatattatcacccatacctccgtcaacagacaaatacttccgaatgcccggaatatccttctcatcgccaatcgtatacagggtcatcccagcggtagcgactaacgagcgtccaggctcgatccagatttctaacattggaacttgttgggctgcagtttgcgcgcgcgtttccttaataattgcatcgacaaaatcggttggctgcagcggatgatcttcggcagtgtacttcacgccaaaaccaccccccacattcatgatctgtgggtaaaaatcaagttcgcgttgccagcgagcaaactcactaacgagcttatcaacaatcatctcaaaaccattcacttcaaaaatctgtgacccaatgtgacaatgaatcccaaccagtttcaaatatggtgcggcttgcgcggctttgatagcctggtctgcttgcccactgtccaaatcaaatccaaacttagaatcggcctgaccagttgaaatgtaatcatgcgtatgcgctgagatccctggggcaatccgcaacataatcgtggtcggctgttgccgttgcgtcgtcaacgtcgtcagttgtcgtagttcaccgaaattatcgaccacgatggtaccaacaccggcatctaaggccatggttagctcggccagtgacttgttattaccgtgaaacgagacggcggccattgggaaatctgcttgttgggcggtatacaattcaccaccagaaaccacatcacaatgaatgtgttcttgggcgatcaattgatacatcgcgaccgttgcaaacgccttactagcataactgatttgatagtccacgtggttttcttcaaaaacttgcttgaatgctgcgatttcggcacgaattgcaccggtatcatagacatacagcggtgtttgatatttttttgcaagggtcaatgtatcgacgcccccgaccattaaatggtgcgccgaatttaatgcatccgtcttaatttgttcgttcacagtttaacctaccttctaaacttttaaaaaaagccggccacgtcatattcgaccggtccggcaatgaacaacctattctgcttcttcgtcgctctttaagacaccaccaacactatagcgatttttctgcatctcacttaaaatcacgtgaatgtgttctgctggtgcaccggtattcttgctgaccacgtcagtaacatctttcaccaagtttttaagttgttcttgtgaacgaccagcaattagatcaatgtgtacgattggcatgaggccacgctcctatcttaattcactattttcgaatgttttaatcttactttaatcttttctattttgcaagccacgacgttgttgatttaacggttcttttctaatgcccagcacgctgaccaattaaggctaccttgcaaaactaatcagaagcacaaaccgaaaacccccattgatgactaaacatgctaaaattaatttaacaaaaatgattatgccacgataccgccattgactgctcgtaccgtggagaaagaaggccccatatgttgactcatcagtttaatccttattccgcctgcactagtatcctagtgggtaaaaatgccagcgcggatggttcgaccatgattggccgtaatgaagattcacgcgccgcttgggcgaaaaaaatgattatccacgcgcaccgcgaattcgaagaaccacagaccttcaagtctcaggatcaaactcatccctttaccatgaccctgccaaagattcgtgcgaaatacacagccacccctgaatggactgccgaatatggcctgttcgaggaggatggcattaacgagtacggcgtggcaatgagtgctactgaaagtgcttactgtaatacacgcgtactggctgctgacccgtatgttaaggacggcatcggtgaagaagcaatggtcactgtcaccttaccgtacattcattctgctcgtgaaggcgttgaacgtctcgggcatattattgaagaacacggcacctacgaaactaacgggattctctttagtgatgtcaacgaagtttggtacatggaaactggtgctggtcattactgggtcgcacaacgaatcccggatgatgcctatgcagtcgttgctaaccagcttgcaatccaagaaatcgactttagtgaccatgacaattatctttatgctaaagacattcgtaattttgtattagacaatcagttagcttcaatggacaatggactgaatttccgggaagtcttcggtacggccgacctttctgatcgatattacaacacgcctcgcgtttggtatggtcaaagatgctttacaccaagtgtcacccagacgcctgagtcgtttgacttaccgttcattcaacgggcggatggcttaattcatattgaccaagtccaaggctacttagcgtcccattatcaaggcacaccgtttgatcccgtcggccagggcactgctacggagaaacatcagtatcggcccatcagtctcgccaagacgcaagaatcacacgtcttacaattgcgaccggaccttcccgtcacgctgagtgggattcactggctggcgatgggtgtagccgctgaaagtgtctacgttccattctatgccggtgctacgaccactccagcagcttatcaagttgctacagaaaaatacgatgctacctcagcatactggattttcaagcacgtcggtatcctagtcgacgcccactaccatgaactacacggggaattacaaacagtacaaaaggaattggcgattcaacttggtcaccacattattgtcacggatcagcaagttgccgctttgactggcgacgaactcgctatggcactgaccaaagccaatcaaaaagccgctgaccaggccttgaacacaatgcaagctctcgccgctgacctgataactaaaagcaccgatatgtcaccgttgaattacgatactgatttaaacctataaatcacaccccctatccgtttttgagggtaaccattattaatgtgccacggctttcggactggtcaaaatgcgcttagttccgttactatccaaataaaactcggtgcacgccgttagcctggcaatggtgtattttttcttagaaaccatcagcatgattatttctaagggaggttaccattgatgaccacgttaaagtatctacgccatagtatcttaattgcgtgttttttaaacttgatttttgccctgactcattgggccggcattgccagcgaccatctgttgatcgctacaaattacgggctcagcgccctgattattttaatggttttgttgaacacgatcgttttgacacatcatccgacaatcatgctcccccagcgacaacaaatttggctgatcaactttgctgccctactgattgcctttctgaccgagtggttatgagcattgtgcatattggttgcgttttgtcatcacttatcgcaaactaaggttaattcttatattaggaggcgctttttatgagtgatgttaacaagaagttcgatagcaagaaggaccagttgagcggcaaggccaaagaagtcgaaggtaaagtaaccggggaccgtgcacgtgaagcccagggcaaaacacaatccttaatgggcaaagctaaggacaaattagctgacgcagaagaaactgttaagggcgtcgtggatgaagctaaggataaaatgaagaagaaatctgacgattaaaatttgtcgtgggcacggcgcaaacggatggtgatcaaaatcaccatccgtttttttatgattacgccacttcaaatgagagcccccatcggcgcacacaaaaacaacttcgagtaagctagtacctcgaagtcacctgtggggctgtttagggtgatgtttaacattttttgatgccgagcgtaacagccaggctgtcaattggcactgttcaattgtgttttgaccgtcgaacccgtgcccactgaaccacgaacatcattatcagaacgacggcaattgcaccgattgcggctggtatcacagtcattccggctaactcaggccccatcggccccagcacaccttcaccaatgagtgccccaagaacgccagcaataatgtgaccgatccaaccccgcgattgactggggctcatgatagcacctgcaaaagcaccaaccgccgcgccaacaatcattacccataaccaatgcatgctgtcatcccctttttagcggcggtgtttgaactgccgcacttctcgaaacacagtcaatcctaattgcccaattgcaatcaatagtgacaatttaccccaaaaaccaggggtctgtcgtttaattttagccattacggacacctccatcttttgataacgctaacaagtgctacttcaacaaatccttttatgcctaatcacaattactgcggctgaagcgcctgggcagcaacggttccgatcacaataagtatcatcgccccgctcacgactggcaacaacgtcattccagcaactgttggcccgaaccatccaaaagacagctggccaccaagtgcaccgaataagcctgcgattaaattaattgtcgtttgacgccgaccatgtgcgcctaccgcatttgcaacgatacctattgttagtcctaatatcgcaacacctatccatcccattgtgaacacgctccatcccgatattgtgtgattaaaattatcataactataatatttatattgagcaatcaaaatgctcattgacccgactaattcagtaatgatgcatatcatttccagtcaaactagtgttcaagctatactgagactatcaaaagcttactaaataagcgatgaataaacttaattttttaatcaagaggtgattgtcatggcaacaacttacggcattttctataacggacaagcgggtaatgggcaagcggcaaccgtcgcccatcaaaccgcgcaagcgctatcgaaccacggcattgagtctcaattactgacaacaccaggaatcccccgggcaattgcgttaattaagcaaacgcttcctcaactgtcagcactaattgttattggtggagatggcacactgaacgttgcaatgacagccctaatccaagctgaagcacatattcgtatcggcgttattcccatgggaacggttaataattttgccacccgctaccagttaccaactgacccccaagcggccatcgaactaatttgtactcagccggcaacccaagcagtcggcatgctagtttgtaatcaacgccgggcagtcgtgagttcactgacattcggtaatttggctgacatttccaatgaagttcgacaatctgagaagcagcgattcggtaaattaagctatctttaccgtgctattcgccatattggtcacaataagtcactgccaattcgatatcaattcaaacacgaaggaaaccacactttaaaaacatggttctgtttgattacaacgaccaaatcagtcggtggacacgtctatagcgcgtctgctccaggaaaaatgcatattagtctacttaacaacattggctggcggcaagtaattccatatttttggttcgcactaacggggaacttgcaaaactccaaggccattacacagctaacggcaaccagtgcacgaattacgagtgcaactggtcaagccgtgacgacacgtattgacggcgacccagcggttaaactacctattgaattgacctatttgacggaccgcttcgaattgatcgtaccagcagtcatcgaataacgacgtattttttattaatataatcaacatattgattgcgtactattaactttttgattatagttaaacatagttattaattaatcccaattaacacagggaaaaaataataatgttcacatcataactttattggggggattacgatggcatctgcttatcgcaaattttgggacaatcttttaaacttttcgggtacagcaacacgctctgagtactggtggcccgttatcattaactacattcttggtggtattatcattgcaattattcagatgattatgggacaccccatcgaggatatttacaattggagcgatctgagtgttaatacgatgagtaaactcatcgcattaatcgtttggttaggaacactctcgttgaagtttcggcgattgcatgacagtgatcacactgcatggtggattttaattgacttagttccaataattgggaccatttggttcttcatcttaatggtgttgccgtcacgctcaaatcgttggcaataatttaactaggcgcaacttttattggctaagcggcccataatggttgcgccttttgtgactgagcgctggcagttaatcatattaatagacgcactaattatgtgaatgttatcattaatataataaataacatcatttcatttaggaggtcctgaggatgtatcaaaatattctagtcccgcttgatggctctgataatgcctacatggctttaaaacacgcggtcaaactagcccagacgtttaaatctaaattatttctggtcaatgttattgatattacacgcctgaatgcgtatagtcctgcagcttacgggggaacgctatatacaaaccttctaaaagtcgcaaaagataatagtcaggacattctggatcgtggtcagcaaatggcttcggcagcacaagtcgaatccctaccaattcaagttaatagttcaccaaaagctagcattgcaactgatattcccaaaaaatatgcaattgatctaatcgtcatgggcaaatccggcaccaacgcggtttctcgaattttgctaggctcaacaaccgcgtacgtcgtacaaaaagcggaagtcaacgtgacagtcattaacacaattgacgaccctgattagacgactaatagaaggaaggaaaaatcaatgatcaaagaacgccctaaattcaattggcttcatctgctcattttcattgtggtcgtcgaagcaatcggtagtctgtcggcatggctcgcgggagacattaaggccgtttacaatgggctcaacttgccagtactatcaccaccagatggcctctttggcatcgtttggccgatcctatatgcgctgattgcgattgctggttacttggttttccagcaggctacgacacaccgtgaccgcctcatggacgccaccctgtttggtatccagctgttactaaactttatttggagcatcatctttttcagccagtcggcttattggtggggcttagtcattatcattgtgcttgatttagtcgtcttactttgcatattacagttctatcgcagtagtcggctagccgcaattttgatggtcccctacttggtatggatctgttttgcaacttatttgacattaggcgtcgcattattaaattaaatataatcgcaattcaaataacggtcccatcagtcattgttactgatgggaccgttatcttattgtattaaagttttaacacggcttaactggtgttgtcaccgccaggccccgtgtataggcactgattaccaatcaactatttaaagcgttctacgttgccgttttcttgaacgatacggcacagcgtaatcttgtggcgcatcttccggactggcactcgtccaatggccactaccctttttagctgggcgggcatcatctttgagacacgtaaaccgtgagccgtgtttatcctggataataaaaattcgactaaattcgttgatggtatcgactaccgtacaatccgtatgcttgatgttgaacacatccgtataaactttactcattattgtccaccccctaggaattaatatttaacattgttaatataccgcgtcttgaatgacaaatccataaatatacatctgctggttattattactaaaaaatgataatcgtacaggtcactgataccccgatataccacctaattcgtttaaattttcgcccgcaccaatcggccttgataaatgagtaattaatcagatacagttgcataattgatacctgtttccattgtacaatcctggtctcgtacgatataatcagaatattctttttgtaagattattacagtaagatggtgacgactagtcgcttcaatgctttggcggctttaccggcatcaccgagtaggttatcagtccgcaagcacgaacaacagggggagtattcaatgaaagtcattaatgtcgcactacacgtcaagcctgagttaaccactcagtatgaagcctttattcatgagctagtggtcaattcttcacaagaacccggcaacggtttctatggccacttcaagcaactggatcatgacagtgactacgagattattgagcactggcaagaccaagccgccgtggatttccataataaaacaccgcacttccagaactttctcgcccatatcaacgagtatctgataactgagcctgaaattacccggatggatcactaacggcttagtactgtagtcacatgggcacaactgacagtcacctattgaatcacaaatttgatccaccttggttcagctaacttgcattgaggggatgctcatgcgcgtactccttaatgctaaaatgccagctgccaagctgtaatcgcaaatccgattcccggcatctgcttaattactaccactaattcacaatagcaacctgttcttcactaatcagtaaagaccggtcatcgccattcgcttctatgaatccttaaagcacatttaaaaaggtcttactagccaataaacgccagtaagacctttacgatatctcaaagacaacttttatagtctaaaatcacctcaaagtaaatttaggcctcatctaattactgtacgtcaatatctgagacttgatagaacgcattaccagtatccgctatattccaaacacttagtaacacttgatagcctttttcattagcagaaatattgacttgatgggttacaaattcactagggatggcaccattgtcattataactagctatcttcttgaaatcactaaacttaagtggtgcgtttggattccagccaggcttggtaatatagtaatcccaagtactagttttatggcgagcagttaactgccaagtcacactaagattgccggccttcacaggtgtcttataccaccgtttggcattttgctcgtccagtggtgcaaagttagcaataccggcactggcaattttgccatcaataaatgtattttggggcgcttcaatactctgtggttcatacataaccgaaccaatattggtattcaaaggcccacctggataccaagtactccccagataagctctgccacccgggttcgtcacaaagccatgtgctgaaacttgaatcacgccacaacctaaaaacgcgatcatcataccaactataataaataagtaccgtaatacatgattcttcttggtgctcaacataagatcccctcctcaattgtcactataacgccctgacaacatgatagccaccaagatgcacagaggcccgaaatcttttctatgcctatcgattccagcctaatactgaacaagtctggaatggttgcccttgtctatcattccagatccataataaaaaatccctcatgtttttatgagggatcaatgaaactacatgtttattgtggagctatatttcgatacgactaccgcagaaccgacaagatcaatcataaatataatggcgagtcatcggaaggccagttccactcggcgctttcactaatagatattgaataacatcgatatttccggcctcaaaagcagctgcacatgcctgtaaatataattgccacatgcggtcaaatcgttccccataattcttgacgacctgttgttcgacctgctgataattgtgataccagatttctaacgtcttttggtaatggcgccgcaagggttcaatgtctgaaaattgtaacttagcagccataatatgtttgagattctcagcaacatttgggatatagccccctgggaaaatatattggttaataaatggatcaacgccggcaccttcatgttgacctgtaatgccatgaattaaagctcggcctcctggaactaagaacgcttgaattttattaaagtacaaccctagattttctttaccaacatgttcaaacatacctaccgaggtgacataatcaaattggccagtgacttctcgatagtcctttaactgcacatgcactttttcctccaaatgacgctgcttgatttgcgcttgtgtataatcatactgttcttgacttaaagtaatacccgttgcatctaacccaaactcatccgcggccataaataataatgttccccaaccactcccaacatccaataatcttttaccaggctgggttgccagcttatttaaaatatgtctcactttattgagttgtgcctgttttaaagtatcatcgtcatgttcaaagtacgcacaagagtaggtcatggtatcatctaaccatagtttataaaaatcattgccgatatcataatgactttgaatatcttttgtgctgcttttttcggaatgtgatattttgggcaagtgtttcaaaaatgaattatgtgtcaaaaaactgtctttttggcggtaagcagaggcaattaattcctgaatgctcccgtctacttcaatatccccattcatgtatgcttcacctaaaaccaatgttggctgattagttaatagcttaattgggatttctttatttaatcgaactttaacagctggcatgccggtaccataccgttcaatttgcccatcccaataagtgacttcaatagtaatatcgaacgctttactaaataagtttttataaatgattttgtctaacataacagtctcctatataatgttttgtgtatgaaacattatatacctgaatttgattttctggaagattgattgtctttatttcactgaacctgtattgaacagccaacggtatttctaataatagcaatgattgtcagttttatttatactgaaaattatgctgttcataatatttatattgataatcttaaactactgatattaaattcagaataacctattttttaaataccaaaaactaaggtctgttgccagacatcgagactattcagcatcaatatttactgcagtcattacatctaaattgcttaaactaaatggaggtattacaaatggatttcattatcgcaattggcggcctcatcactggcatcggcctcatcatcaatgtctttaacacccggatcaagtatggctggttcactcactatcagagcaaaagtcggccacttaattatgttagtttattattaatcataatagggttaattattattattggcaaagcctatctaaacggacaactaaattaacataaaaactaaattgctgatgcagtacagtattcatttgtatgttagcctatatagcagtaacgtgaagtctatatcatttataactaattcatttattcaaactaaacactacactgggggattcaatgatgaaacagcaacagaaattagcgcgtttaacaactgttaatcagcttttagaacagctaaacacttcagttccaattgaaaaagttgaaatcagaaaattaattagccaagcctacgcaactatcaaccaaccagattcagttactaagcgttatcaacaaatacccgacgcaatcaatgaattaatcggtcaacttcaagtgatggctgtcgctaaaaaataccatttctcatctgaacaagatcagttaattgccaacttaacaacttctacaaataaaatgtttgcccacggttggtatggcctaattgccatgagcggtattggaaagtaaacctagcaattcataaagagtgttccagctacgatttgacccattgcaggcatccccaaaagagcatctttttaaaagattagcgggtcatgatgtcaatttttgttactatttgaacttaactgtagtataaaaggcgctcagcaaatgagcgccttttatgttactgctacaactttgattgttgttgtaacaacgttcctacttgacttccgaagtattcacaattggctgagtaccccgttccgaaataatggtgaccatcatgttattgatcagttgcagtttcttatcgtctgatagctgcatccccgtatctttctctaaacgggcgatcgtgtcttccgtaattgaaacggccccttccacgatgaccttgcgagcagatagaattgccgaagattgttggcgttgtaacatcgcactggcgatttcagtcgcgtatgcgagatgcgttaagcgcgtctcaacgatctcgacccccgcaacatttagccgttcttgaagttcttccgttaaccggtcagaaacttcggttggattactccgcagcgtaatcttcttgtcgtcatcaaacgtatcatatggatattcagaggccacgtgccgcaccgctgattcactttgaatctcaacaaattgttcataatcatccactgcaaagagtgccatactggtatcaacaactttaaacacgataacggccgcaatttccacgggatttccccggaggtcattaacttttaaaatggcactgttaaagttgcggacccgcagtgaaatggaaaacttactggttaacggaacggtcataaacagccctgaatcacgaattgtcccgatatacttaccaaaaaatgttaacacgcgcgcctcgttggggcccacaattgttagcgaactagccccaaaggccgcaataataattagcaatgcgcccaaaaagatactcgcaaaatgatcgccagtcgcaccggcccaaaccagccaaccgccaactaacacaaatgcgatcgctaacactagaccaatatagccattgatatgaaacacttgtttttctttcatcaagactaccccctttggctcttattatagcataagcgcctcacatgctcgcaaatctaagttcgatggcaagttccaaagtcagtggtggcaatcaccttcgcggccctcccggctcagctattcaaacgtgcctgaagtccatccccatcaacgtgacttaactcggcttgccacttttccgctcccgtcccgcaaaacaccaggtcgtcatcactagcaatagtgtgaatggccaagcgacttggtaggggcgcataaacgcagcagttaactcaattttggttttggccttaatcgctgatgcagcagtccttattcgatgattagtgtgtttaacttgactgtgaaccttttgggccacctgctgatgaatttgagctttgatacgcactggagcggactgcaatgaccgtgcttttaacacttgcatataattggcagcaaccaaccggcgggccttagccgccgtgattggctcgtggaccgtttgcgcggtttgctcagttgctaattggtggtcaaccacgcgtaacgtatcacgtttggcttgcttaggaattgataaagtagtgaccgtcgtcgttgcatacgttcgtatctgtgtcttagccgttgtcaaattagcggctaaagctgacacaaaaatggctacggccaacgatgtgccaatttgccgaaacacgccaatcacactttgtgacgctgtcagtaactcaccggtaaaatcaccggccgctaataccgtaattggcccaataatcgtgccgtagcccgcaccaaccagtaacgccgccaatgcaaactgccagtactgactaggactcatcaggctaagtaccccataacccgtagctattgcgagactaccactaaagatcacgcgccgcgcaccaagctttgctaacaagaaaccactgattggtgaaaaaataaaaatcatcattgaagcgggcgtaatcataatcgccgccatcaattccgtcttactttgaactttcgtgaagaaactcggcatcaagactaatagtcccaccataaagacccctgataacacggtcgctaacgccgcaccgttaaactgtcggtctttaaatagggctaatgggaccatcggcgctgagacgtgggcctccatccagacaaaggcaatcaatgttagcgcactagtgacgcccaggctcaggactacgcgactcgtccatccccagtcattacctttaaccaggaccaacgtcaatgccaataaggtcgtcatcactaaggcactcccaccgaggtctagttttacttgaccatgactagggtgccgccatgatagccaggcgatgcaaccacacaacgcgacggcaactaaaggcacgttaatcaggaaaattccccgccacccccaaaattgagtgaccgcaccaccaatggttggtcctaacgctgcggctagcccttgcatcacgcccaagcttgcaatgacccccgtacgcctgctgagtgcaacactctgaataccaatcgtcatactagccgggaagacgatggctgcaccaatactttgaatcgctcggccagtaatcagcagcccgacactgagactcaatccagaagttagtgaaccaataccaaagagcccgagtccaatcaagtacatccgcccacgtccccagacatccgctaaccgaccgagtggaatcgccagactagcaaacaggacggtgtaaatattcagtgcccacgacaggtgcgtcaaatcagtatttagtcccgtctgaattgctggcaacgcaatattcataaccgtcgtatcaagcatacatagaaaaatgccaatcatcatcattgcaattactttcgtcgattttttcatcataatcgcctcccgttaagttaatgggagtatatctggtaaaatggtcataaataaatacttacgttacaaaaaaggagatgttgtaaccaatgaacccacaaacacgaaaacgccaaaatttaactgcggtttatgcggccttactacagcttatgtcgcaaaaaccactcagtcgtatttcaatcacagaactttgtcagcacgctcaggtttctcgcacctatttttaccgtaatttcgccaacttcgatcagattattttggcctatcaaaaacagactatccttcaatatctgctccaattaccgcgacaatcaaaggttaaattgcaggtattgatgactcaatatttcactctcatgcaacaaatggcagcgacaaatgcgttattgatcaaaaacgaaaaaacccagatttttattcaaagtttcgaagccgtctttgcattactcattaaacaagaccgtattatcggttcaagcaataccgcgcttcgccaaccgtactacacggcttatttttctggtgcggtcatcaatatgctcgttcattggcaacagaatgggatggttgaaacaccggcctatctcgctcaacaggtcactcggttcgctctacgcgataacgaaagtaggtcctaaataaaacggggtgccgttgccgacatcccgtttagtagcttctttaatttacttatcaactcagtcgcgatggtaacgttgtttaacacgcttcatcgcttgtttgccaccgaacatccgctgaattttagcctgctccaactggcgtgaattgagtccttgatagctcatttcacgttgtaatttttgatagctttgtaaccgttcagacgttaccgtgcccacctcaactgctgcccgtaccgcacaaccaggctcgctagtatgggtacaatcattaaacttacactgtgtcgccaatgcggcaatttccgcgaaagtttgatttaaatcacccatgaagatttgtaactcacgcattcctggtgtatcaatgacacaggcgcccgttggtagcggtattaattgccgactcgtcgttgtgtgccgccctttgtcatcatctgtacgaatcgatttcgtcgccaagatatcctggcccaacaatcggttaatcaaagtcgacttaccgacacccgaagagcccacgaaggccaccgtttgaccagtcgttaggtatggttgcaattcatccaaaccctgacccgtttcgaccgaacaagtgatcgttggtacgccgacactgacatccgccacagcccgtaacttagtggctagatccgtgcagagatccgccttggttaagacaatgaccggaagtgcaccgctatcccacgcaatcgtcaggtaacgttctaaccgccgcacattaaaatccgcgttcaatgacatgcagataaagatggtattaatatttgtcgcaatgatttggccgtcttggcggttcacggcaccgcgcgccaagacactctgccgtggcgcgattgcttcaatctgcgcctgattatcagcggatgaagataggcacacccaatccccaaccgccggaaatgccgcgggactggccgcttcataagccagttttcccgtaacttgtgctgaacgttccccagccgtcgtgatgacttggtaccaatcacgatgttggccgataatccggccaagtatttgaccgttttccttagtcaagtcggcttgaaccgccgtcgtcaatccatatttaattaaattaattgtcaatttttataatcctttcgcaaagtgacttaccctaacgctctgcgaattaaaaatgcgcccagtcttatcccaactgtgcacaaaaaccgtccggcatgtctatctgccaggctattcgtcacattagggtacacgaaactaagcgggtccaacccacttttttcgctcaacaacaccctaacgaatgcccgacataaaacacccctcctatatttgataattacaatttaacaagtctcaccaaaattgtcaatttaaagcgattcaccacggcaattcaacgctaatgtgcgcattaaagtcttgctggcgctttagtttggctaaccgggcagcctgccgctcttgatagccctgagcaacaaacgtgtattctggtttatcagcgactaacagtggtaattcaatattacggtccgtcaccacgaacgttgaaaagcaagtcaatcccaaaaaccgttcgccggtcttcaagtgttcaccaatgattttagtaaatacctcgattgagcggtgaccaacgcccgaaacgtaagattccgcacacattgagtcttgtaaccgaaacggcaataaaaaattgacctgatcgactgacacggtcaccgtctcaattcgagccactcgcgatgcggcaatcgatgaattatcatcgatagtcgccaagatttttccgccaaaaaccgtgtcgtgctcattcaaatcagctgaaaacacacggtgattggtaattgataaagtctgtgaaatatgaattggttccatgtctgcaccccgtcatctttaattatttttatttatatcactgcaaacgacctacaatgtgattaaaacagactaactagctcgattgttgttcggacacgtccttcctgctacgaccaccgaaaccgactgcttttatccttatgtcatcgtcggctttgattccgattcaagacacatcgttagaatgtgatcagccgccacaattaatctgaaagtgattggctatacttcgtcgcaaacgcccaaaatttagcaaccacggcagcgtgattatctggacgcttcatgaaagccatctgactgcgaatagtaggcgtcagtggaatggctttaatgttgtcaaaaccagtgagatcaaatgaccgcgccatgacaaccgagacaccatcaccctgattcagcatttctaaaatgagatcaattcgttgaccatcataaaccatctgtggcgtatgcattttttgaaatgccgaaaacaacgggttatcttcaccgatggtatctttcaataataaaattgattcatgtgccagcatcgacagactaatctcagcttgttgcgccaacggatcgtctttcggaacaaggaccacaaactgatcggtctcattcaataaaacgtcataattattgggttgatccccgaaaatccgtgtaaatacaatgtcgacattcgtatgatccagtgcatgcgctaaccgatcgacactcgcctcactaaattgtaatttcacttccggataccgcttcgtaaatgccgtgataatatgaaaagcctggtattgtgctaaagatggtagtccccgaacaaccagcgactgcgcattatgagcggtattagcggccagaacttgttgtagctgacgctcttcgcgcagaattgcttgggcccgtggcaataattgttgcccaacccgtgttaacgtgacttgccgatgcgcacgttcaaataattggacctgccaatcgcgctctaaagccataatgtattttgaaatggtcgactgtgacaaaaacatgcgttcagcactgcgactatagttctgggtcgtggcaaggtcaacaaacactgccaatttccgtgtttccataattaaccctcttctaactattcctatttagaatagtttaccacatattcagaattgttcttatccgaaacaagctctaaactaatagctgttgtttttatcaattaaatattgaggagggcttgcgtgccaattggaattattactaacgtgtgtgcaatctttttcgggggtattgtcggcgcattgaccggcaaacgaatgtcacaacgtttaaaagatgggctgaatatgtcctttgggatctgttccatgtgtatggggatttacgcgattgcaccactaaaaaatctagcggcggtcatctttgccgttattatcggaacaggtattggattactttgtcatttgggaactgcaatcaatcacggcgctgccgcgatgcaacgtttcatttcacggtttgtcaaagcaccagcaacttttgagaaacaggcttttgaacagacaatggtcacggtaatcgtactattttgtgccagtggaactggtatttacgggactttaactgaagggatgaacggcgacgccacaattttgatttccaaatcgattctggacttctttgctgcggtaattttcggtgctaacttagggttagttgtttccttaattgctgttccccaactaatcatcctgactgctttattcttaatcgctcacctagtctttcccttgaccactcctgacatgattctagatttcaaagcggtcggtggtattttaatggttgccagcggctttcgcattattgccgtcaagatgtttccgaccgccgatatgattccgatgatggtcgttatcatgccgatttcatggttatggatgaattttgtattgccattattatagataaattattgaaggacaaattaaaaagcagttctgagcccacaattatggcttgctcagaactgcttttagtcagcacgtagaaggcttgcaatagcaggtcaacccagtcggccgataataaaatccagtggccattgttcactaaacttaaaaaagaacgcactaaagttaataccaacaacacgctccaatcagccaaccgacaagggacgagccaaaaatccctcgtgagtcgcaggcaattctaacggcgtcaactggtataactgtgtttgatagcacgctagtccacgttctaaatcaagaacctcaacacggcggggcgcatgggtcaagccacagcccactaactttaataccgcttctttagccgtccaaagttgccaccctaaccgataacgatcttgcaccgataaagcctgtaatagctgccattccgccgatgtaaaggctcgccgaatggcagtcacatcatatggacggacctgttcaacatcaatccccagaggtcccggaccaaccgctaccatcactaactggtgcgtgtgactaacactaacacctaatcgaggatgacttggaaaatagggctgtcccaatcgatgataagctaatggtaccgataacacttgctgaattaattggcgactcacggttcgctgagtgacccgccgcatttttttagaaacatcgaccggcatctgaagccactgccgtttaaagacaacttgagtgattggcattaacttaagtggacccctttatccacgtataccacgtccccggtcattccagtcgatagattgcttaataaaaaggcagccacgttgccgatctcacgcgtttttaccggttctccatcaactgtcatactgcgagataattttaataattgctgatgctcatgaatacccgttaccgccaacgttttgactgctccggctgaaattgcattcacgcggacttgttgtggtccaaggtcacgcgccaagtaacgcacatttgcttccaacgcggccttagcaacccccatcatattataatttggtacggctcgctctgatccaaaatacgtcaacgttacgagactggctcctggtttcagcattggccgagctgctcgggcaactgcaatcagcgaatacgcactaatattttgtgccaaatcatatccagctttcgtggtattcacaaaatcaccttctaaggttgctttatccgcataagcaatcgcatggataatcccatcgatggcaccatactgttgtttaatgcttgcaaatgcccgctcaacattgtcatcatcagcaacatcacaggcaattaacggcacatctggcgcaacaaaccgttgtaagctttgcttcaaacggtcattttggtaagtcaagataacctgggccccctgtgcaattaatgcctcggtacacccccaggcaatactgcgctgattggccacacccatgaccacaatggtcttacccgataaaattccatccatacttatcattcctcacttatttaaaattgccgataacgggcttggcgttgcgtaaccagttccgccaccgactttgctgttaaagcagttaatgtctcgtcaatggctgttttcagcggttgacaatctgctgcggttgctacttcaggaataatccgatcgataatcccatctgccaataattctgtcggcgtcaagcgcattttttccgcagcttcagcagcacgttgcgattctttccataaaatagtggcatagccttcaggcgataacaccgagtaagtactattcgccaacatccagacttgatcaccacatgctaaggctaatgcaccaccactgccaccttcaccaacaatcaaactcaaaaatggtactcgcaattgtaatcctgctaacaaacagtcagcaattgctcgtccttgtccctcatattccgcatcaacacccggataggcacccggcgtgttgattaaggtcacgaccggctgccgtaattgttctgcttgccgcattaaccgcaatgcttttcgataaccgctaggcgtcgcacagccaaaatgccgagcttgattctcggccaagttttgacccttctgaataccaataatggtgacgggccgttgagcaattgttgctaagccggcgattacagctggatcatccgcccgttgacgatcaccatgacaatcaaaaaaatcctctgtcaagccatcaatcaacgtttgaatgctaatcttactagcatcacgggctgcttgaacttgttcataggccgttactttagacatcctgatgacctccctgagtgattgttaataatcgttgtagtgttttccgtaaggctggtcggggtacaatttgatctaaccatccattggctaataaggtttccgcccgttgaaaatccgcaggtggtgtctgttgaatggtttgttcaatgactcgccgacccgcgaatccaatgagcgctcgtggctcgctcaacataatgtcaccctgcatcgcaaaactagccgtgacaccaccagtggttggatcagttaaaattgtaatatacaacagtccagcttttcggtgatttgcaaccgccgtggacaccttagccatttgcatcaatgcacgagcgccttcttgcatacgcgccccgccagaagcagtaaccatcacaacgggaagcttttgggtcgtacaagtttcaaataatcgcgtaattttctcaccggttgccgcccccaaactccccatcataaatttagtttccatgacacctaagccaaattgataagtcgctaacgtcccaataccagtcaatacgctctcattcaagtgtgaggctgctttggcacgctgcaacttttctaaatatgcagggtcatcaaaactgacgggcgcacttaggtccgcatcccgctcttcaaaactcgccgtcaattgttgaacacgttgccaagcaggcaagcgaaacccataatcacaatggggacataccttgaattcaccgagatcttgggtataacaatcttcatgacaaactggacagcgcgtcaataacgcgtctgggatattatcccgtcgaacagctaactgccgttcagtgggtgcttgaaacttgcgcttgggcatcacttaaccatcctttcaaaaagtcttgttcgatataagctgtggtataggtaccacggctaacagtcgaatctgcaactaatcctgctaagaaggtccggttcgtttgaaccccatcgatggtcaattccaataaacaacgatgcatcttgcgactgaccatcttccgattaataccgtgaacaatgatttttgcaatcatcgagtcgtaaaacggtgcaatcatgctaccagtcaccacaccagcatcaatccggactcccagtgtccccattgggtagatcaaccgggtgatttttccaggttgcggtcgaaaatcgtggtacggatcctccgcattcaagcgacactccatggcaacaccatgaattttcacatccgcctgtttaatttttaatggtataccagctgcaatttgtacttgcgctttaatcaattcaatacccgttaccatttcagtaaccgtatgttcaacttgcaaccgcgtattcatttccaaaaaataaaaatgatgctgctgatccattaaaaactcataggtacccgtatttgtataacccaactttttggttgcgttagccactaattgtcccaatttggtccgttcagcagtcgtgatgaccgcacatggactttcctctaacactttttgatgattccgttgtagcgaacaatcgcgctctggtagataaataacatgcccctgttgatcggctaagacctgcacttcgatatgcttcgccggggcaatgattttttctaagtacaaccgatgatcatcgtatgaagcttgagcttcctgctgagctgttcgaaaggccttcgctaaatcttgatcattgctaacagcgcgaatccctttaccgccacccccagcagcggctttgatcataactgggtaacctaaggtatgggcagcttgcatagccgcctcaacatccttaagcaccgatggactgccgggaatcacgggtacgcctaatcgttgcatggtctgccgggcattttctttgtcacccatctggtcaatcacctcaggacgcggtccaataaacgttaactgacaatccgcacacatttttgcaaattccgcattctcagataaaaagccgtagcctggatgaatcgcctgacacccggtcaaattagcagcgctaataattgcttgcatattcaaatatgactggttgacgggactcgccccaatacagaccgcctcatcagccagatgtacaaataagctctcctgatcagccactgaatagacagcgaccgctttaatccccatctcatgaagcgcgcgaataacttggaccgcaatttcaccacggttcgcgactaagacttttttaaacaatcgccatacctccttcaggcttgcattacaaaggttaaatcagcactaacaacctcacgaccagcacaggtaatcacgccatggcctgttccgatttgacgacgcaacttagttaacgttaccatcgcttctaaccggtcacctgggcgcacatccgtcttaaaatcagcctgccgaattccgccaaaaaagacgttattaccatgatgctccggcatcgatagtaaagccacaactcccgtttgagccaaaatttctaataatactggccgaatcatcgttcttccggtcagtgtcggactctgaaaaaaccattcattaatcgtgactaatttttccgctgttgcgctgacacctggttggaccgctatgatacggtctaataattgcagcggaaaccgttggggaattaaatccgtaacttccattaaacggtcgtctcctcaattgcaaacaatggttcatcaaattcaaccatagttgcattcttaattaaaacttctttaacgatcccactaactgggctagggacttcgttgatcattttcatcgcttcgattacacacaaggtttcccctgacttgacacgatcacccacctgaacaaacggcgcctgtttcgggtcggcagctaagtaagccaccccaactaggggcgccgtgaccatcgttgttcccgattgagtcgccacttcagtcgtcggtttgaccactggtaccgtagagtcggtcactgccggctgtgaacgcgctgaatttgtctcagcagtttcagcttgtttattcaaatgcagttcaaaggttgtcgtcttgacgtccatgacttgagcgctggattgattaaactgattgatcagggcggtcatcgcttccgtatccgtcatactcatacattcacccacttcttaaaggcaaccacggcattatggcccccaaaaccaaatgaattactcaaagcataggttgcggcttgatgttgagttgctggcgttactaaattgactggacactcaggatcttggtccgtacaaccaatattcgcaggtaactgacccgcttgcagagcaccaatcgttgcaacagcttcaattgcacccgcagcgcctaataagtgccccgtcattcctttagtactgctgacttgtacatcttgaccaaacaacgcgctaattgcttgagcttcggcactatcattcgcatgtgtggctgttccatgagcattgatgtaatccacatcacgcggctgaatgccggcttccgcaacggcttgttgcattgcacgtttggcaccagcaccatccggccggggggctgtcatatgataagcatcgctagtcgttccgtaacccacgacttcaccaagaatctgggcgcctcgggcttgggcatgggccaacgtttctaagactaacgtcgcacccccttcacccatcacaaacccattgcgttgacgatcaaacggtaacgaagccaacgttgggtcagtggctttcgacaacgcagtcagggacgcaaaccctgcaataccgatttcgttgacggaagcttctgaaccacccgtgatgatcacatctgcctttccttgacgcaaatattcaaacgcatcgccgatggcattcgtcgccgacgcacacgcggtcacaatcgcttgactggtattctgtgcgttaaattgcatcgcgatattaccaacaaccatgttgatgattgaattagggacgaataacggtgaaactcgtttgggactcttgtcgtgcatcttgatcacttgcgcttcaatcgtcgttaaaccaccgatacccgaaccataaataacgcctaatcgttctggatcaatatttgcttcatttagtccggcttgcgccatcgcttcacttgcactgtatagaccataaacggaaaataaatccaatcttttcgctaatttcttttcaattcgttcgtctggctgaaaatccttaacctcaccggcaactgtaatcccagtgggcgtcgcgtcaaacttcgtgatgggcttaatcccaacttgtcccgcgaataaccccgttaaaaattcatcaacactattaccgaggggcgtcaccgcacccattccagtcacaactactcgttctgtcattggataacctcccatatcttatatcgtcatgccaccgtcaactgttagcacttgtcccgttaagtacggttggtgcaataaaaagtcaattgcttgggcaatttcgtcgggcgtcccaaagcgtttgagtggaatatcacttaaggcagccgccgttacacggtcattcaattgtgccgtcatggccgtcgtaatcattcctggggccaccgcattacaccgcacttggcgccgagccgcttcctttgccgtcgttttagttaaaccaataattccagccttactagccgcatagttcgcctggccgatattgccatgtaacccgaccacactagcaacattaacgatggcgccttgtcgctgtcgctgcatgacttttaaagcgtatttggtcatattaaatgtgcccaataaatttgtttgaatcacactcatgaaatcttccgcgtgtagccgcgttaataactgatcatgggtcacaccagcgttattcacgagtccatctaagcgaccaaaatttgtcatcacggtctcaattaaatcagccgccgtttgatcatcgctcacatcaccaactaattgcgtcaaccgtggatattcagccgttaatgcttgccaatcggccgcttcaatttcatgatgaacgtttaaaataacgctggccccctgagctgccagccgtttgactgttgccaaaccaatacccttagcagctccagtgactaaaatcacttcatccacgctcacgtacctcctcagtatcctgacaataattctgccaatctgtcacatcttcaattgaccaaacccttacccccggcaatgtttgtttggcaaaagttgctaaactatgccccggtccaacttgaataatctcatcgacctcatatgtcgcaattcgttgtaagcaggccgcaaagtgcgttggcgatactaactgttttaccaacgtttccttgacagttgcctggctaaagggggtcacggtcgtattactgatgaccggaatttggggtgctgcaatattaacaaatcgtaatcgttgcgccaacgcctcactcgctgctgccattaacggcgtgtgtgaagccaccgcaacgtctaatgggaccacccgtttaacgccgtgtgtttttaaataggttcgcgcagcttgaataccagctgcatcgccaccaataacaatttgatcagctagattgtaattagcgggatacgcaacccctactgcttgggcactttgacaagcggctgcaaccagtgccggcgttaccttcaacgccgcgaccatctccccgggatgctgtaatcccgctcgttgcatatatctagcccgatcggcaactaacttcaagccatcagcaaatggcaggacgccagctgcaatcaatgcggcatactcgccaaggctcaatcctgctaacacggtcggacactcattaagcaacgctgttaaagcacgatataaccccatattcatcgctgtaattgcaaccggcatccgttgagcatcatcgatccaatcagcagttacccgcagatcccagtccaacacttgattagcttcgtcaatcgtggcttggtacgctggtaacgtttgataaagatcggcccccatatcggcaaactgttgtccttgaccactgaataagattgccgttttcataacttagtcctcgctattttcctgatgagtcgccacataatcaactaaatcaccaaccgtggctaacgcgtcatccgtttcgatttcgatatcatattcgtcttcgatcttatcgatcacttcaaaaacgtccagactatcaagtgctaagtcttcggtaaagttcgttgtcatcgtaatcttgtcagcatccacgtctaattgttccacgatcatctttttaatttggtcaaaaatttcagttttagtcattgttgattcctccagaatttttaaattaattttaaatgcttgatttcagttatcaattaatactcaattacgacactaccgacggataacccgccgccaaaaccggtaaacaccagcttgtcaccacgttgaacttgcttttgggcaaccatttcggcaaatagaatcggttcactggctgccgcagtattgccatactgtgcaatgttcatcggtaattgttccgtagctaagtttaatttttgaccaacgctcttaacaatacgtgcgttggcctgatgaagcacaaatgctttaatatcactcgactcgagccgtgcctgcatcaacgcctgctcaattgagtgcggcacttgcttagtggcaaagtcataaacccgccgaccattcatctgaaaggcccagcggttagaatctgcaccatcagtccgtgtcgaccacggattcacctgaggttgctgtcccgccgttaaataatgcccgtcagcgccaaacgtcgcgtaatgaccgcccagccagtgcccagtggccgtattaggcttagcagtaatcaatagaccacccgcaccatcaccaaataaaacggcagtgctacgatcatgccagtctactaaccgactcaaggtctcgctaccgattaacaaagcggtctggcccggttgtaagtattggtgaaccaactgcatcccataaacaaagcccgcacaggcaacattgatgtcaaaggcaattgctttttcagccccaattgctgcctgtacttgaggagccgtcgccggtgtcaaataatccggtgacatggttgccacgatgatcaaatcaatcgccgtcgccgctagccgactttgctgcaacaactgctgggcaactgaaacagctaaactcgtcgttgtctcatcggtcgcgacgtggcgagaacgaattcccgttcgctgcttgatccaatcatcagaagtcgccatcagttgcgttagttcttgattcgtgactttggtcgtcggcagtgccttagcactcgctaaaatcgaaaaattagttgtcatggttggttacaattcggcaatgcttttaaaaaactttcccaaacgacaatcgccgaattgccattaccacctttctattttgaatcagttgcaccaacgataaaggttaaatcagttgtgcaggctgccttgtcaccgaccatcgcctgacaactcaccgttcccatgttggaccgttgcttgaccatttggacatgcaacttcaagacatcaccgggacggacaattttgcggaacttggcatccttaatggcgccaagataagccgtcttaccagcaaacttttcagatttcaaaatcagaatcgacgcggcttgcgccaaagcttcaataatcaacacgcccggcatgaccgggttaccgggaaagtgcccttggaaaaatgactcattgatcgtgacatttttcgtcaccacgatcgattcacccggatttaattcatccacccggtccatgaataaaattgggtaccggttggggattaattgcataatttcacttgcttctaacacactcatagttagtcgctcctttcacgacgtttgggaatggcattaagttaatcgtccggccaaatcttgtcaattgatttcagcagattgatttacagtatgttacattttttagtagtcaaatcccggtaagctgggctctaatcgagctttatttttttgcgaaaatttcttgacgatccattttttgcggtcataatccgtcaacgaactggcacagtttagcaatttgactataaagtttataatcaaattgctaacaagttttgacttcagcaagcagtgatacaatctgttcaactgtcactagcttagatgcacgcaaaaaaaattgcatctaagaactagcattcttaaacacaattgttatgacgatctattaatttaaaggattacccatcagtctaaagccatcacatccataagattttaacgcccataacttttaacctaaacggcaatgcctgttaatttttgaacatccccagagattgttggcggtaaacggatggactctgatgaaaccattttttaaaagctctcgaaaaagactctgggtctgaataccctaacaaatagctgatttcaatcaagtttagcgattgatctttcatcaagggtaccactagggttcgacgcgcaatttggacttcatcattaaatgtggtgcttaaagtactaagatgacgctgcaaggttcgtttactgagattcaaacttgttgcaatctcgtcaattgagaaggaaccactaggaattttcttcaacaatagtgcttgaacagtcgcgagcaatgattggttgtgttcaatagccagtttttgttggtctaaccctggttgcaaaaatgcccacattgaattattggccgaaataaacgcccgctgtaagtccgtgacttgaaactgaatgcaattatcagccaattgttgaggtcgaatgcccatcacggcatcaatctgatcaccatacggatacttactaccaactgaaattggcttgatgagttttcccgtacctactcgtaacaagctgattaacaacaattgttccgtcataatcgtgaaacgcggcaactcgacgccaagactatttcccaaaatatgaatattgacaatatctggcttggtcactatctctaaatgaaccggacctgccaatgatttataggttgccatgcgtgcaatcgcttgttcaccatttttagcagctaatgctgcaaaaaaggacggcataaacgtattaatgttagtaatattccctaaactaagaatcatttcatccgtcaattggttgtcgaattcgttcattaactgccaatactccacatcagaaagcattaattgttcttgccaaaccactttattaataccggcagcttcaagcaggctatttaaatcaacgccaaggcttgccataaaacactgaaactgttcagaaaccataatcttcacactaatcactcctactaactggcatgcatcatgataaaatcaaaaacacgagtcggtaaaatcgccttagcaagtaccagcggtttagccccaaatccaattaaataacgcacccgtggtcgtttctgattggccgccttcgaaatagctttagaaataatttttggatcagacatcattcgcgacgagtattgtcggcgcatacccgcggccgccttggtcgcttgtgtttgatatgcactgtgacgtgctgaggcttctaaatgatccgcagcaatgaatccccagttggttttaatcccaccaggttcaataattgcaactttaatgccaaagtctttagtctccattcgtaatgcgtcactaaacgcttcgacagcgtacttggttgcgtgataccatgcgcccatataactcaccaaccgtccacccatggaagaggtattgataatgcgtccttcacgttgcgcgcgcatatacggtaaaactaattgtgtcagccgagccatcccaaataaattaacctcgaactgttgcctggcttcatcaatggaaacatcctccacagcgccatatgagccataccccgcattgttgatcaaaacatcaatgcgtccttcactggcaattaaagttgctacggcctgactaagcgactgctcattggttatatctagtgacaagggcttaacgccgtatggggctagtgcttcaagtttattcaaccgccgcgccgcaccgtaaacaacgtgaccttgctgtgctaagtctttcgctgtctgaaacccaataccgctgcttgcacccgtaattaaaataactgccatctcaatgacctcctatgtttttcaataacaatagtttacatagaaaatcgcaacggcttaatgatttatcacgtcatcatcataacataacatgccattttttggcgcaggccattaacagctgatattaatcaactcagacaactgtaaaatcgcactcattacgcctggcgctgttgatcaagccctgatggtctaagcattttaaaataactacaccaccaaaaattcgcttgaaattaatttcaggcgaattcataaacatcctgctgccaatttctcatcctaatcaccatccgccaatgcccccgctaactagccggcactgcacttccgattgcaatataacccacaacaggacgctgaaacccaccatgacacctaaacactgcccttcaaagcctgttagcgtcggcagttgcaagagtccgagcttgcgccgtttttgacgggctaacttaatcatgacttcacccgtgaccacaactaatagtggtaacatcactagccaccagcggctgccgaatgaatcagccaagccggcactattaaaatgtgtgacaactgtttgcggtgccaaaccaatcataatgacacatatcaaaacggcaccagccacaattgttcgcacgatccaagtaaagactcgcattacgctcacctcatttttgacccagtatagcaagctggcgacagcacggacagcaaaatgcgttcttttaaacggttaattatcgaagccaactacaatcgtgcgaccagctagctttaatgatacggttcaactggttgcatgtcttttttctaataccaacgcaaagactagtctagatcaactaagcttgattgatttttaccattaaattatcgccatcgaaaaagtcgtttcagcacgatgaatcagtactgaaacgacttttaatcgattgcttttaagcgactagttacctagtcgagattaatcaatggtaatcatagccttaattgtctttcgattttgcatgtcttgataagcccgattaatgtcggctaatggatacgtttgcgtaaatacccggcccggattaatattaccgtccaaaactgctttgagtaagaactgtttgtcataagtcgtaacggaggcggaaccaccagcaaccgcaatattttgagcaaaggttgacccaagtggccggttattataatgtggtacacccacatagcctacgcgacccccattatgcaaaacacctaaagcttggtcaatggccgcttcagtgccgacacattccaacgccgcatccgcgccgccaccaaggatttcgcgtaccttcgcaatgccttcgtcaccacgttcagcaacaaccgcggtcgcgccagaagcaagtgccatttgctgccgatcttcgtggcgactcatcaagacgatttgcgcggcaccccgcaacttagctgcaatcacagcacattgcccaacggcaccgtcaccaataaccacgactttatcgcccttttgaacgtttgcacaccgtgccgcatgataaccagtcggcatcacgtctgccagcgtcaacaatgacttgagcatcccttccgtatagtcactaggttgaccaggaatcttaactaacgcccaattaccataagtgaagcgaatgtattctgcttgaaagccattagaccaatttgtgtggcccggatgccgatcacaagtaccatcgaaaccagccaaacaagccgcgcactcaccacagccatgggtaaatggggtgatgacaaagtcgcctggcttgaccgtcgtaatggccgagccaattgcctcaacgattccgatagcttcatgtccttcgttgatcgaatgggcagccttgtcatcaccatgcgcatatgaccacaaatcggaaccacaaacacaagtccgcacgatgcgcacaatgacatcatcatcagcttgtaatgttggtttgtcaacttcctgaacagatactagtccagctttttcgaaaattgttgatttcatcctaatcacctttggccgcctcaaccaaaattcaatcagcggtcgttcccttcatcattaaaataataatattaaaactaatacacatatattataacaataatctgcacgcaccagttactgattgcaccaagtcgggtatcaacaaatactttagttactcagataattgtgaccaaactcgcttgttacttatcattcagaagctttccataaaaaatgcgcccaaccatgttagtttcctagcaaggtcgggcgtctcccctttgtcgattgaccactttcaattcaagctcgaacccactttaatagtgccgtagctgccaataagctagatgcaatccacatcctaaaacaccaagaacgatcaacgttacaatcgggatcaaaatgccacttaacatgctgattttaacaatgtttagattggcaaaaatataagctagcaaaccatacatcagccagtgaacgacgcactaatccaccacaaaaacggcatcggaaaaactgcccgatgccgtttggtgatattcgattaaaccagttaatttcaaatacgattcaagtacttcatgggcgcaataaaatcttgccagcaacttgcccggtctcaagggcccggtgcgcagcggctccttctgctaatgaatagactgtcgctggtcgtatcgtcacgcgatgcgtgagcacatcatcaaacaattgattggcacggcactgacgagcagccgcgctgtccaaataatcccataaatcaccagtcatcaaactcttggattcggacattagcttgactggatcaattactggtggattgccagctgccatgccataaaaaatgacccgcccacggtgcttggtagtcgccagactaactggtagtgtcttaccgaccccatcaaacaccgtatcaaaaaaattatgatgggtcgtgtcccaaggatcatggcgcataaaaacggtggttgcgccagcttgataggccaattcagctttcgccggtgttgacgccacaccataaacagccacctcattggccacgagcagttgcgttaatagctgcccaacaccaccgctgatgccatgaatcaagactcgatcgtgcggttggttttgtgctaagtcatggactaagaactccgcagtcatgccctgcaatccaatgctagcgacctgctgatcattgattgcccgtggtactttaatcgcctgatcagctggaaccgcgacaaggctagcgttggcaaacggcacgtcaacgaataacacccgatcaccgcgtttaaaattcgccacttgcttaccaactgccacaaccgttcccacgccttcataaccatcaatgtacggttgatgcttttccaaatgataggtaccacgacgacgataaatgtcggcaaagttgagcccgatatacgttgttttaaccaatacagtatttgcagtaacgattgggtccgccacctcaccgtactgtaggaccgacgcatcgccaaaatcattaaaaaataatgctttcaactaatcacccgtcttttctaacaaatcgtcaatacggcccgatgctgttaccaacgtcaagaaacggtggttccaaatccgatcttgataaaaatcaatcgtttgttgcgcactcatcatggaattggccgtcgttgtcgtcagcccccgaaccatttcgaggtggtagcctaacccatgagccattttaaccgtcgtatccacacaaaactcgacttgcgcaccacagatttcaagtgtttgacatccaatcgccgtcaattgggcttgtaaatccgtgtgataaaaagcgttggcgtgcgttttctggaccacaatatcggttgcttcaattggcaactctggtatcatctgccaatcggcagaaccagtgactaagtcagcatcgtgatgttgcacaaacacgattggcttattttgagcccgataactcgtaatgcgttgttgaatacccgcaatcacggttgccaaattggtaaccggttgggacccgcgacagacaccaacttgcatatcaataataatcagtacatccgccatgttgacccctccgtaaattaatttaactggcttggttagcgtcaactattattaacgacgcccacaaagcagtaagctgtttttagactagcacattatccgagcgtttcccagcatttaatcgaagtagcccggcacaacaacatcgtaacaaacaagatcagtcaactgtatcagccgtgcgaccatccaatgcgcgccgcatccgtcgcgtatagtctcttaagactgctgtcgctggttggtgcgtcgcaatcaaatgcacgactgcactaccaacgatgaccccgtccgcaatttgtgccatggcctgggcctgggctggctcatggataccaaaaccaattgcgacaggtaacgtagtcgcatggcgaatcttcgccaccagtgttgctaaatcagtcgtgatgtgtcgccgggtccccgtgacacctagtgatgatacgacataaatgaagccccgcgcctgctgggcaatcgctgcgatgcgtgcatcatcactcgttggcgcaatcaatggaatcaaagcaataccatagtggtctaaggttggtcgaagttcaccagaagcttctagtggcatgtcgggaataatcaagcctgcgacattcaaactttgacactgctgggcaaaggcagcataaccaaactgataaacaatgttcgcataggttaaaaatacgagtggaatagttgtcttctctcgaattgccaccaccaattcaaaaacgcgttggggtgtgatgtgttggtcaaacgcacggagatcagcggcctgaatttcgggaccatcagccacagggtctgagaacggaatgccaatctcaacgagatcacaacccgcttctgctaacgcaacaacttggtcaactgtcgcttcaaaattaggatcaccggccactacaaaagcaataaacgccttatgatttttaaaaattgttgttaaatcagtcatcaattgtcacccctcgatactttgcaattgccgccacatctttatctccacgaccggataacgtacaaataatagtttggtcacgtcgcatcgttggtgctaattgttgtacgtaggcgactgcatgggcactctcaatcgcacagatcaccccttcgaccttagcaatcagttcaaatgcttgtactgcttggtcatcggtgatccccacatattgcgcccggccactcgcagccaggtaggcatgttccggtccgacgcccgggtaatccagcccagccgagattgaatagaccggggcaatttgtccggctttatcttgtaaaaagagtgacttcatgccatggaagataccagtccgaccacgttcaatcgtcgcagccgtcaacggcgtttgaacacccttacccgctgcctcacagccaatcagctcaactgacgtatcatcaagaaaagccgcaaaacttccaatggcgttactgccgcccccaacacaagccacgacggcatccggcaaatgacctgtttggtccaggatctgctgtcgggcttctacactgatgacactttgaaattcatgtaccatcattggaaatgggtgtggtcccgttgcagagcccatgatataagctgtatcatcacagcgccgcgtccactcttgtaaggccgcattgatcgcatcctttagcaccattgaaccagtcgtgaccgggtggaccttggcccctaatagttgcatccggtaaacattcaatgcttgacgatccgtgtctttcttacccataaagacgtcgcattccatcccgaacaaagcagcaatagttgcagttgcgaccccgtgctgtccagccccagtttcagcaatcaatcgctttttgcccatcttctttgccaacagtgcctgccccaagacattgttaatcttgtgcgcacccgtatggttcaagtcctcacgtttaaaataaatctgagcaccacctaattgatctgataatcgttgtgcatggtacaacaacgatggccggttcgcatagttattcaacaagtcagtcaactcttcttgaaactgcgcgtcctgtcggtaatgttgaaaggcgcgatccaaccgctgtagctcggtcattaatgtttctggaacgtactgaccaccaaagtcgccgtaacgccccgcctgtgattgatttttaatcatactaattcctcctaatttctgttaataatggtgttgacacgcccgtttggtgcgcccgttggaccatcagattgattttttcacggtctttattgcccgccgtctcgacaccactagccacatcgaccattgccgggtacaccttgttgattgccgttacgatattcgtcggtgttaaaccaccagccaagataaacggccggacgggacgctgtgattgtaattgattccaatccaacacctgtccactacctggacgggcattatccaataataagtaatccgcttgacattgcgtagcattcgctggcgtcatcgcttgaatcaccggcacatgggcggccattaaggacgcaatccgaggatcatcgacggtagcgtgtagctggaccacctgaataatgtgttgttgcatgagagctaaaatttccgataattgattagttgtaaacacgccaacacgccggatacgcggatctaattgctgtgacagttggcgcgcggtcgccatcgtaatccgtcgtcgacgaccgggagcaaataccatcccaattgcgtctgggagcgcttgattaaccatcacgacatccgctggtcgcattaagccacaaattttgatttgagtcatccacgcacccccgcccgcaattgcatgacggcttgacctttatctggtgcacgcatcaatgtttcgccaactagcatggcgtcaaagccagcagcggccaactgttgaacctgtgtggccgtttgaataccagactcagcgaccacataacactcagccggaactgcttgccgcaactgacagctcgttgcaaaatccacactgaaatcggttaggttgcgattattgataccaataattcgggcaccggccgccaccgctagttgaatctcagccgttgtatggacttcaactagcgcacttaaattcagctcatgtgcaagtgtaataaaggccttaagttgggccggcgttaaaatactcacgataagtaggactgcactcgcaccagccaggcgggcactcgcaatctgactagcagccacaataaaatctttacgcaatgtgggtaccgagaccgtttgcgcaatggcttgtaagtaagacaactgtcctttaaaataccggggttcggtcaacactgagatggcatcgatcccagcagcaacatagtcttgcgcaatctgtaaatagtcaaactcagccgcaatcagccccttagaaggtgacgcccgcttaacttcaccaataagctgtaagcccggctgggccagcattgcttcaaatgataaaacgggggtggtcatttttcgagcttgttgaatgcgcttcacacgctccctaactggcaccttctgaacccgttgctgactcgcctggacgagttgatctaaaatcatgaggccatcaccgcctgactactctgaattaattgggccaacttagccgcggccgctccttgatcgattgtttgctgggccaactcaaaagcggccgctagatccaactgtggcttggcaatatgcaacgccgcggcggcattcatcaacaccacgtcacgaggggcccccggttctccagcgagtactgctcgcgtgatggcggcattaacttgggcactaccaccaataagagccgcatggtcacaacgcgtcagtccaaactgttcaggcgtcaggattcgcgttacttgctgcccatgattaattacgatcacatccgtaggggctgccgctgaaatttcatctaagccgtctcggctatgcacgaccatggcatgtttaacacctaaacgcgtcaacacttcggctaatggagccattaaagcttgccggtatacccctaatagttgcatctcagcatgagctgggttggctaagggacccagtatattaaaaatagttggaatcttgatttgttgccgagccggagcgacgaatcgcatcgcctgatgatattcgcgcgcatacataaaggcaaagttggtccgctctagcaatgctagactctgagcaggtgttagatcgattttgataccgagtgcttctaaaacatccgccgcaccactcttggacgacgccgcacgattgccgtgcttggtcactggtacacccgcagcggcgaccactagcgcagtggtcgtcgaaatattaaacgaattcgaccggtcaccgcccgtcccaacgatttctagcgtgggccgtttaactttaaaaggtaacgcctgggaacgcatcgcagttgctgcaccagcaatttcatcgatagttgcctttttgatggctaaggcggtcaaaaagctcccaatctgtgcgtcggtggcctgacctttcataatttccgtaatgacttgttggctcattgtaaagtctagattttcttggttagtgagttgcgcaatcgctgtttcaatcataagtattcctccactctcgtctgcttaatgtttaagtgctaaaaaattacggatcagttgctcaccaacggcggctggcgtcatgattgattctggatgaaattgaacgccgtacagctgacggcccacatcttccactgccatgatttcctgatcatcgcttgtcccaatgattcgaaagttaacgggcaaacggcccgcatcagctaccaacgagtggtagcgcgctgccatgaactgcatcggacaatctttaaatagtgatgacggctgcacgtgcattaacgtggcttgcccgtgaactaaatgctgggcgccttgcagcgaaccgccaaaagcggtgaccatcacttctaatcccatacaaatccccaatatggggacctgaccagctaattgttgcacgacttgtggactaactcccgtgtgggctggcgtccccggccctggtgataaaatgatatggtcaggttgtaatgccttgattgcagcaaccgtcaaatcgtcatttttaatgacccgtacatcgggcgtcagacgaccaattagttgatacaagttataagtaaaactgtcatagttatcaattaataattccacctttaactcgtcctttcgcgtcttgtactgcattaacgatcactcgttgtttattctggcactccttaaattcttgagcgccgatactgtcagcaacaatgcccgcacccgctggaatcaccaactgttcattcattcggtaggccagccggatgccaattgccatgtctaaattaccgttacaatccaagtaaccaaagcaaccaccataagcaccccgcggcacctgctcataatgattaatcagggtcattgcttcaatcttaggcgcgccagctaacgtcccagctggaaaagtagcggcaagcacttggagtgctgtagtagtcggcgccacttctgcggccactcgagaccctaagtgcatgacttgcgaataacgaattaatcgccgtaaattagtcacccgaacacttttaaactttgcaacttgtcctaaatcgttacgtcccaaatcaactaacatattgtgctcggcaatctctttaggactggtttgtaattcatgagccaactgctgatcctcggcaggtgttcgaccacggcgtctcgtcccggccaatggatacgtcgcgacttgttccccatccttcgttactaacgtttctggtgaggccaccgtcatttcgaaattagcctgtttaaaataacaggtatacggggccgctgttttttgaagttgctgataaactgccagcaatgacccgctcatggtccccaaacatggattagcatatatcatttggaaaatatcaccagcgtagatgtgttggcgaattcggtcaacctgacgcgcataggtcgcttggtccgcttgcatgtgtaatggttgctgcaagtcaaatggtggcaaagctattgattgctgcaattgttcaataatggcggctaactgttgcgttagagccgtttgagtcacggcgtaagttgccgctaaatccgcagttggaatcagctgtgtcaacccaagctcatgatgtcgatgatcatagacgagcacactcgtaactaagaataaacctaagtcatcgagatctgcggttgctggtgatttcaaatgcaacttgggtacaaattgttgaacatactcatagccgaagtaccctatcaagccccccgtaaatggtggtaatccttgaattcgtggtgttcgatattggtttagaatggcttggagtgtctcattagctggtcgtttgtgcttggctagttgctggcccgtgagacttcgctgtggtttaaaactaaaatagctatatcgttggtgccgatcaatcgtcagcgcgaaaccgttccccatctggtggacaattttagcaaccgcaatggggtcaaatgtggcgagtggtcgtttgaccatcactggtacgtagggataatgatcctgataaggaatcaaggttggtaatgttggattcatattgaaccactcctcattaataagatagttttacttgagttgtggttaattgccatcgttgctgcattgaactgccccctatcaaaaaaatccgtccatgactaatgacagtcaaggacggatttttccgcggtaccaccttggttggacaccaaattaccccattcaggttagacttgggtcccagcttagcgaaatgcaaacacattcccgggaattgacggctccctatcgtcgcgaggtagtagaacaaagctgttcgttagtcgcgccctcagtggtccatttaataatttgcgttcgatcgcactctcagcaacggcgactctctttacgggcatcattatcttgatctccacttcatcggtttcatggacgaatattaagttgtcattaacattaaaactcaatgagcaatttgtcaacacttttatcttaatttaatattatgtgactgtgaaattaacacttattagtcaagttgctgccaaaaagtcttgtagtaatgccagaccaaaccagcagaaataattccgacgccaactaatacaatgatattaatcagcatagctgccgccgcgaacagctgaatcagcacactatagatcacaattgtcagcacacccacaatactgcaggccaacaagttaagcatcaaaccaagattaccgccgccccgattaaacaattgggtcacattagtccaattcgtcagccgtagctgataatcacgcttaaagtaatgttgggcagctaggtacgtcccccaagcagcgcccaatattagagccaaatctagggctaatggtgctcgcccagcgatacccaccactagaaccatcacgccattaatcatgatctggaaccaataacccaagtaaaacttttgtcgtaagtaacgggacattgggattggcagtgcacgcacaaagtcaaagttcattttatcaagtgaaatgagattaccgactaatgaggtttgattaacattgacgatcgcaccggccatcccactgacaaaccagacaccgagccagttcagcgatagccgactaaaattaggagcggtccccgaaaagaaaacggtcccgactaaaatcaatggcagcaggattgaatctgtgaataattgtaaggctaaactgggttctttcagtaactgaaactggtaggtacgcaaaattttattgcggttatgttgtcgtgaatgtcgacgcggtggtgttgccactaacactgaattgacttgcgtaagctgttccgctaagtgggtcaaaacaaaccgtcctgtcagtgcgaataaaatcagcgagatgacaattaaactcgcccaggttagcaaactcgtcattgtcaacggcgtcgtgaaaactttaaaaatcggtatcaataggggtaatgctgcgcggtcaacctgcgttccggtgtcagatgatgagccgcgattcatgaagtagagcccgactagcactaagacagcgttaaggcctaacatgacgttcatcaccattttttgatgggcgcgaaacacggttagcttggttaagccaaaaactattagggcgcacaagcatagtaacagactcagtattaggccatacatcaagacggccatcagcacgcctaacaccacaaagattcctgcccgtgttgcggtcatgataaaaattaagagtaacggaatggtaaagggtaccgtgttgaatatcacgaccaaaatcttactcataaaaatttcttgattgcggaaaggtaacggtaagtattcaacaagatcattgccggcaaaaaagacgttataaatacccgagatactctgtgaaattcccaataagataaataacgccacatagaacgtaaacatgcctggcaacttgctaaaatcaaagaccaacatcgtcaagccataaatgccaagaaacatcaaagcattcaagtaaaattgccgcattagcttcttactcaaggctggccccgaagcgccctttttacgtagccgatccgttagttgcggattcaacaacctgagattaacagccaacaaaacacgcaactgacttttatgcatcatgctcaccctccagcgcatcgacaaggtgatcatccgtcaaccgcccggccatttgtaaatatatcgcctcaagtgattgttgcggatgttgagctagtaattgttcaaccgaaccggtataaatcaattgcccctgcttcaaaattgccaatcggtcacataactgctgcgccgtatccagattgtgggtggaaaaaatgaccgtcttgcctttggcagcatgggccttcatcaaattttttaaatcaaaagcagcttgggggtctaacccttgcagcggctcgtctaaaatccaaatatctggatcgggaagcaacgccccaatcaaaatggctttttgccgcatcccgtgtgaataactagccatgggttcgtcaacgtgttcagtcatatcgaacagtgacaccagctgctgtcgccgttgctgaacggcttcctctgattgctggtaagcggcagctatcaagtcccaatattccatcgccgaaagttgaagaaaaatatcgggtgtgtccggtacgtaagagatcttttctttgacggcttgtcgttgctgttcaaggtctaagccatcgaccgtaaccgtgccactcgtcggtttaatgatactgactaagtttttgatcgtcgttgatttacccgccccattgtggcccagcaaaccgaagatttgtcctgatgcgatggttaaagtaagctgattcaatgctgtcttatccccataacgcttcgttaattcgtgaatttcaatcatgtgattatccccctagtcatcagttacggtttattataccggaatcgtctgagaattcgaaaccggagcggtacgttgctcattgattaacgcttctgtcgccaatgactagttccatcatgaaactaacgatttcaccgatccagaagcatcagttaacctcaacttctagggcaagtttcatcagactgttgattaaaaaacatattgcaaccaagaaccgttaaatcacctgcccccaagatacttatgattctagttcgatcagggaccgtcttatttttaataattgtcatatacaagcaaatcatttaggaattttcatcgccataaatcaagcacaatttatccgctggcattcccatgttaggcctttttgttacttacaattctgaaagaactccactaagtccaattaagaagctggtaccgttgctgtaacgcaaaaaagttcttctctgacaaggcatcaggccctatcaaggaagaactttaatttacactttgttatttaaataacggctttccatcgcctggcgggcaagaacagcgtcctcaaaatgctgaaacggcttgtgtaacaggtagcgccccttgtagaaaaatgtcgccacccatttttgagtattgctatcccagctgacaccgatgacaccactcttattacgcttagacataatctttgacggtaaatcagtgtgatgatcatgaattttcagattgcttaaccgccccatactggcagccgttttgggattacgtcgaattaactgcgaccgactttctcgtgtcaaacacccacagcttcttgctcgcccatgccgcaacgcgtacgaatcagctttggtctgattgccacagcgacactgacacaaccagagggcattgccatttttggcagttccacaacgtctaatgactgttaagcggccaaacttctgacccgtgatatcgattaaagtagtcatattaacgcctccatttaacggctaattatgacgtttcttcaaaattgcactcacaccaactagtaaggttgctgcagtcaaaccaagtagttccgccgcaacactagcttgccgatcatcattggtttgcggtaaagtcgcttgtttgtgggtggctgattgatgagccgcggttggcttaacggatttagtcgtcttcgccagtttaaccgtttttacattggctggtcgtgtctgagcaggctgttcaacagcctgtgcttgtttgagatccactgaccgcttgacgctagcttgtttagcagttgttgttgcgactttatctggcgtgtcagtcgtcttaattttatccgacttattaactgtcaccgtcttcactggtgtttttggtgtctcaccggttgaaggcctatcggtaacgtaacgaatcgtttgaacatcatccacgctagctggcgtaaccatgactgcctgagtacccgttaccaccgcatgatagcccggaatactgaacgccgcgacgcgctcaaaagtgtgatccgcctgattagtcgaccaattgctatacgttacgtccccggtgacctgatcaacccgtttagtacgagtgaatgtcatcgctctgaccgtatcatcgtgcaactgcgtgccagtcgtactctgataatgtacggtttgcgtgattgtcttggtctcggttgtcgcagttgtcacatgtgcaagctgaaccagatagctgtgaacgacaccatcatcattgaaaatagctcctgaaactggatagctatcgcggacaagcacgtagccctgattactgtaatcagcaattgtgttagccgtgcggtaatcggatgatgtctgataatcgccagtcaaactgacggtcgcgagcgttttatccgtggtgacatcaacataggtgaccgtcgccttttctgcgttaatcgcatacgtcacaataatgttggtcggttgcgccgcactagttactgcatcgtttcccgtgacccgcgcccggtcagccgtatagccaataataacgggtgacgtcacggtggtataacgaccagtagctgaagtcccatccagccaatcagtataaactacggtaggctcaacttcatcaatcgtggcatcccgattaaacgtaatcagttgaacgctgtcagtgccagccgaagccccattttgataccgatacttaatcgtttgactgacttgtttcgtcagatcttgggcggtcgttcctactggatacttcggtccgtctggattgtctggatccattggttggcccggcgtacccggattccctggtgtaaccgtaactaacttatgcttcagtgtcacggtataagttttagcaaaatcatcgacatcgaacagcatccccgatacgggataattatcacgtaccagttcataaccgtttttaacataacctgcaatggtttcagcggtccgataattggattgtgtccgatagtcaccagtcaaattggccgtaacgagcgttttacccgtcgtgacatccacataagtgaccgttgctttttcaggttttgccgcataggtgacgaccacctgtgtgtctgaatctgtattagcaactgaatcacgaccagcaacctgtgttttatcagccgtatagccagtaatgacgggtgacatcacggtggtataacgaccagtagctgaagtgccattcaaccaatcagtataaactgcggtaggatcaacttcatcaatcgtggcatcccgattaaacgttattagttgaacgttatcagtgccagccgaagccccattttgataccgatacttaatcgtttgactaacttgtttcgtcagatcttgagcggtcgttcctactggatatttcggtccgtctggattgtctggatcaattggttggcccggcgtacccggattctctggtgtaaccgtgactaacttatgcttcagtgtcacggtataagttttggcaaaattatcgacgtcgaacaccgcccctgaagtgggatagttatcacgtaccagttgatagccattcttgacatagctcgcaatcgtttcagccgtccggtaactggacgtagtctgatagtcaccagtcaagctttttatagcgagcgttttacccgtagtgacgtctacatacgtgaccgtggcgttctctggcttagcctgatacgtgaccacgatgttcgtgtcagcatccgcattgcgcacctcgtcattacccgcaatacgcgttgaatcagcaacatagcccttaatttccggtgaatcgactggcatgtaatgaccagtcgttgccgtaccagtcaaccaatcggtataagttagcttattgttaacctcatcgaccgtcacgctgcgcttgaaagtgattgtttgcgtattagcgtcggcagcagtacttttatcctgatactgatagtgaatggtttgaccaacctgcttaatcaagtcttgcacagccgtacccgctggatatgtgggcccgtttggattatcggggtcaatcggctcgcctggcgtacccggattctctggggtgagcggcaggagtttatgttgcaatttgacagtataagcctgagtacttccgtctttatcaaacacagcaccggatgttggataatcatcactgaccagttcatagcccatattaaggtactgagcgattcgatctgctgtccgataattcgagacggtctgataatcaccagttatcggatctgttgtcagcaccgctcccgttgtcgtatcttcataggtcaccgtggctttttcaggattagcctgataataaacttgtacatctggactgagatccgtcccactcaccgtatcacgacccgcaacactggttgggtcagccgtataaccagtaatcgaaggtgaatcaacagcctcaaaacgaccagtcatggtcccatcatcagtcaaccaatccgtgtagacgactgtgccattaacttcatccaccgtgacgttacgactaaaattaaccgcttgaacattgttcggtttagcagtgcgaccatccttgtataaatactgaatggtttgactgacttgctcagttaaatcctcaaagtcagtccccactggatatgtgggtccgtttggattatcggggtcgatcggctcgcctggcgtacccggattatctggcgtgcgtgttacaaatttatgaacaagtgtaacctggtacttttgaacactgccgtcttggtcatagatcaccccggctgttggatagtcatcacggtacaattgatagcccgcattctcatatgcggcaatcgtatcagctgtccgatacgcatccgttgtcccgtacgctccttgtaagggttccgtcttaatgaccttgttatcagtttggtcaaaatacgtgaccgtcgcatactctttgttcacggtatacgtcacaggaatcgtcgtgtcatcatcctgccatacaacggcgggattgccggcaatactggttgaatcagccgtataaccagtaatcaaaggtgaatcaacggcctcaaaacgaccagtcacggccccatcatcagtcaaccaatctgtgtagacgactgtgccattaacttcatccaccgtgacgttacgaccaaaattaaccgcttgaacattgttcggtttagcagtgcgaccatccttgtataaatactgaatcgttcgactgacttgctcagttaaatcctcaaagtcagtccccactggatatgtgggtccgtttggattatcggggtcgatcggctcgcctggcgtacccggattatctggcgtgcgtgttacaaatttatgaacaagtgtaacctggtacttttggacaatgtcgtcttgatcatagactaccccgactgttggatagtcatcactgaccaggtcgtagcccgcattctcatacgcggcaatcgtatcagccgtccgatacgcatccgttgtcccgtacgctccttgtaagggttccgtcttaataaccttgttatcagtttggtcaaaatacgttacgatcgccgtttcagtcttggccaaataacgatacgtcacggtaccgccctgatcagttaacgtgccattataggctagtccagtattgggtgctaacgcatagcccgtcttgggtttggctgccgtcgtgtaggtcaaatagtccgtggccgttgcgtccgtagcatgtgtcgccgtaccagtttccgaagcatctacctgagtctcaccattagcatctacatgttcgtagaggtacttaaccgcaatatcgccaattgtcaaggtgccaggaatgactgaaatggtatagtttttattcaccgaatcatcagcatcaggagtggccgtaattgtcttagttccaaccgcactcatgccgttggtcacacgatactttaaggtctcaccattaactgtcccagtaaccaccgccgccaaattcttttgcgtcccattcgaccaataaatcttgttgggaatcgtaattgttgctttggctggatcaattgtcagcgttccattgacatacgaaattttataattactggtatcggctgccgtagtcccagtcattgcataagtgccgaccgtagtataagtcgtcgcaccactgccatctgctgcaactgcggtaaatgctaactgatcataattggtcccgctagtaacagttgcagtcgtgccatgtgctcggccgtcataaactgcattatcatccttgaccgtgactgtcagatctgctggcgtgatcaccaacgtcccatccgtcgtggtaacggtatagtttttagccaaaatcgccgcttgcgtgggatccgctaacgcgtatgtcaggttgtcataggtaccgacgttcgtgtcagtcgtcgtagtaaaatcaaagtgatcatacacggttacagtcgttacagctacggatgtcccctgaggcttgccattataggtcactgtatcattggctatcgttaacctgagatcagcagcctgcaccgtaccagtcgtggtgaaaactgccgcatcatccagaatataattcgaccccaacgcagcttgaactgccgcccgacctgcttcattaagagtaattgtatatttgccagtgtccgccccggtcaagttagcgtcgatgccttgatacgtataagtaaagtctgccggcgttaaaatactttgaccgaccttgccggctacgcctggtttagcatcgccaattttgccgttgctaatttgaaggatattttgctttgttgcatttttaacggtgactaccggcaacattgtcaatgctcccgtatacggctgtgaaggccgaagtataattagcccattcttaccagtggtggctgtgatttttacagggacaatgttaattgtaaaggtataatcggaggtcccagtcgaaaaggttgggacaaagtcatccaaatcactggtcgaggtatcgtaagcattatagtcttgcataacccggctcatcccagctttacccgctgcattgatcgtcactgagtaactaccaatttggtcgagcgttgaaaagtccgtatctccggaatatttcgtgacctgcccatgttcatccgtatacacaacatcaacgtaatcattgacatcagcagagtccagaaaaagtgcatatagcaaattgaccttgttgccgtttacatcttctaagtaattgcccgctgcatcttgaatgtagtaggcgacgtcgttagccggcgtctcatctggagaactaatatgagattctagatccgccagcgacgcctcgccatagtccatcgacacggtccccgtagtgactaacgatacggtcggcttcgtttcagcttcactggtgatagctgaaaccgcctgtactgcagacttagtgaccggcgtgtttgctgacctgctcgctagcgcacccgtcaatgggagtgcccgacttgtcactgcagtcgtaatggtcggtgcttcagcagtaggtatgctggctgttttcccagtttccgtacgcgtttggctagctgtcgtagcatcagtgagatcatttgccactgatgaacttgtcgtctcagtgtttagcacatctgtgtcagcactcgtagtagccgttttagttgcggatgctgatgtggcttccgtgttagtagatttactggtgacacttggtgcactagcacttgcgccatcagtacttgatatgctagcacttgagtcagcgctacttgaagcagtaccgacttcggcagctggcttcgtagctgctgtcgactggcgattactggaagctgaagttgccccagttgaatcagtagtcgctttagtatcctgagtcgcggccgttacatcagtagcagcttttgcatcctgagtcgcggtcttagtagctgtcgccgtactagctgattttagtacgacggcattgctcggttctgccatgtcggaactaacgctagcgctattgtcggccgtgtcaacccccgtacccgttgcggctttcacttgttcaacttggctaaaagtcaaaccgatgccaactgaaaatactgtgatactagcagccacccagcgccgccccgatttataaagcttataatgagacttactttccaatcccaacctatttaaacgattccgcataattctgcctccaaagttcaaccgtacctggagcaatcaagttatttagctgagtaatatttggtgcgtttcataccgtgccgaaacgattgtgttaatcatcaaactatcacctaattgaccccttcaatcattagtatacgttcaaataagttgaaataacaagtgcataacaaaaaatagacgaaattatttttgagattatttaattgtagtatcagttcacactataacactgcattaaaatactgatataaccaacatattgacacacttattttgaatctggctcatccacatcccagttcggtacttatcaaacaatgtatagcatttgttatacggctgaaatcgtttaccagctatttagcagcaccaaacaattttcatcgcccgcacgccaaccatatcacctaatattgttaagacgcgcagatcatgaactgtttttccacaccaaaaaagcccctctgaataggtttcattcaaaggggcacggacatgccgcacgatgttctcatttaagctgttaccaacacacttccgatgaacgccagcctcttacgttcaaaaaccatcgtcagccgtctgaagacggtctggtttcgctagtaacttcatcactgacacaccctaatctaaataggtactatgcatcccaatatagcctaaattcgttcccattggtttagccgcgactaatattggataaatctgatcataaaagtttgaagcagccttcgaaaggcccttgttgcgtagcgcctccatttgaaaactgaccactaatttatttaacacagcaattgaatagcgatgatgctccaaatcggctttggccatcaacccgattttacgttcacggtcggtaagactagtgtcgagaacgaagtcaactaactgactcaataacgcctgttcatcgacctgatgtttccccgtacgtccaaacatcggctttcacctaactctcttttattttatcgtgctcgctttgagcaatctcccgtttagttaacccggccgccagcttagcactagttatacacgtcaggtacgcgacaaccctgttcaaataaatcagtttagtctgatatcaagtgattcatattcagctaattgacgcatcccaagaagcattgcgtactcgtattactatcataatacttcaaattaggaattacgagctatctcgtaagattgttaaattataaatccaagtacagcatgctcacattgtgaaccgacctaaattggtcgatgatttgacgattgagcgtgtcactaacttcgccaataaaaaaagctagctaatcattaaaaatgattaactagctttccatcatcagctcagcctaagctgcaaccgatgattgttgacgttgtgatttagccacgacgacgttctgggatccgggcagccttaccatgtaagttacgtaagtagtataacttggcacgacgtacacgaccttgacgaacgacatcaattgcagcaacgcgtggtgtgtgtaatgggaatgtccgttccacaccaacaccgttactgatcttacgaacagtataagtttcgctgataccggaaccatggcgcttgataacaacaccttcaaataattggatccgttcgcgagtaccttcaacaactcgtgcatgaacacgaactgtgtctccagcacggaaatcagggatgtccgtacgaagttgttcattggtgatcttttcgatcaattggttttgacgcataatgtatttcttcctttcgccgacattcgtgacaacctggtcagcggaacatcgttaatgggcacaatagccaataaatagaataccatattcgagggtgggcacgcaagtttttttgaactcttcacgactaacttgtcctaattaacggcatagcctacacttccgactcatccgccttgatatctgctaacatctgtttagcttttcctgacaatgatagccccgtcaacatgtccgggcgccgttcataggtccgtttcagtgcctgttctaagcgccaatcatcaatttttccatgatcaccactcagtaagatatctggtaccttcataccacgaaaatcagcaggacgcgtatattgtgggtattccaggagaccgctcgaaaaagaatcccccggagccgattccgaattacccagcacacctggtaagagccgcaccgtcgcatcaatcatgaccattgcacccagttcaccaccagttaaaacgtaatcacctagcgagacttcatcggtgactaatgaccgaatccgctcatcataaccctcatagtggccgcaaataaaggtcaagtgttcttcctgagcaaagtcttcagcaacgtgttgattgaactggactcccgccggatccaataagatcacgcgaccgggtgccgggtgtttttcctgaacgctggccaaagcatcaaaaattggttgtggttggagtaacatgcccgcaccaccaccatacggataatcatccacatggttatgcttgtcggtcgtaaaatcccgaaaattagtgacatcaacattgatgacgtcattttcaatggcattgccaatcatcgactcatgaagcggccccgcaaacatctctggaaacaggcttaaaatatcgatttgcattaatcaatcagcccttccattaattcaacagtcaccacgcccgcatccaagtcaacatctttaatgacctggggaatcttaggtagtaagacgtcagactgaccatgatcccgtttgaccacccaaacatcattcgcaccaggtgacagaatctctttaatagtccctaaaggctcgtcagcggtcgtcacaacttgtaggccgacaatctggtgatagtagtactcacccgctggcaaggcatgtaatgcttcagcaggaactttgatcgtccaccccttatagcgctccacatcattgatgttatcgagcccttcaaaggtaagaaagtacagccccttttgctcacgggccttcgcgattttgacagtaatcccgccagtcgtttcatctggggttttaaataaactcaattgttgccctactttaaagcgttcttctggaaaatcagtcacgacaacgactttcacttcaccacgaatgccgtgggtgttaactagggtgccaacacgatagtaatccattagcttcctcctcttaattagcttgattgttattcgttttaaatgtcatcaacatgttacaactaatctactcaacgacggtcatcgagatactttgactcgtcctcaaaaaccggaacaagatataaaaaaactcttaaacaaaacatcactgcttcgctcaagagtttttttgttgtccgtcttcgatcgtaagccggacacgtttaggtcctgaaactcggacactatacacaattgtccgaattgccgaagcaacccgtccctgccgaccaatgacccggccgatatcttcgggattaaccgttaagttgtattcaagataacgcgtggtttccttaaaatcaactttaatatcgtctggatattgaactaacggggtgacaaccgtggtgattaaagctttaatatctgccatgatctattaccgctttattatttagtgaacttagcttcgtggtacttcttcatgataccggccttagataagatattcttaaccgtatctgaaggttgggcaccattgttcaaccaaccgaggatatcttcctcttcaagtttaacttgggctggttctgtaagtgggttgtatgtgccgacttgggcgataaaacgaccatcacgtggtgaacgtgaatctgcgacaacaatccggtaaaatggatttttcttagaacccatccgctttagacgaatcttgactgacatttaaacacctcccgaattctttaacaggtaataatataccagtaaatcaatagcttgtaaaggactttttcttgacaggctaaaaaaacttataaattagcgtttgcgacgccgcattgctttggctaagcgcttttgttttttcttcttagtttgacgaaccattcgcttcatggccatttgttgcatcttaccaccgataccgccaccgccattggcaccacccatgagaccttccataccagcaaagttccctttggacatttgattcatcatctttttggtctggttgaattgcttgatcatccggttgacttcatgaattggccgccccgaaccagccgcaatccgtcgacgccgagatgggttcaacaaatccggatctgctttttcggcattggtcatcgaataaacgattgcccggatatgggcaatgtctttcgggtccatgttgatatttttcatcgctggattgttagccatgccgggaatcatcttcatgatatcttccatgttccccatcttgtcaacttggtctaattggtcgataaagtcattgaagtcaaaagtgttttcctgaatcttcaggttcatttcttcggcttgtttttcgtcatattgctgttgcgccttttcaatcagcgtcagcatatcacccatgccaagaatccgatccgccatccggtctggatggaagacatcaagatcagtcatcttttcgccttgaccgacaaacttgattggcttaccagtgacggcccgaattgatagtgcagccccaccacgagtatcaccatctaacttcgtcaagacgaccccggtcacatccagcttatcgttaaagccctccgccgtattaacggcgttttgaccagtcatcgcatcgatcactaacaaaatttcgtcaggatgaacgagatctttaatattggccaactcgttcatcaactgctcatcgatttgtaaccgaccagccgtatcaataaacacgtaatcattgtggttttcttgcgcctgtgccatcccttgacgcacaatctcaacgggatcgacatcggttcctagttggaagactggaacgtcgatttggcgaccaacttgttgcaattgttcaatcgcggctggccggtaaacgtcggccgcaatcattaatggtcgggcatcctgttcgttctttaatttgagggctaattttccgaccgtcgtcgttttcccggccccttggagcccagccatcatgatgaccgttggaatcttcggcgatttgttcagtggaactgccttttcacccattgttttcgttaattcttcatcaacgattttaacgatttgttgggctggatttaaaccttccagcacctttgcgccgagcgcacgttcgcgaaccgttttaacaaaatccttgaccaccgtaaagttaacgtcggcttcaagtaatgctaaccgaatttcacgcatggttgctcgaagatcactttccgaaatcttccccttgcgccgtaaattggtcattgctttttgtaaacgttccgttaggccttcaaatgccattagtgtcacctaacctttattattattctgagtcagcttccaagttgactagttgttgaatcatcttaattaactgggtatccccatggtaattttgcttaatatagtcagagatcgcgtcaacttcgtgattacgttccacaaagtcgtggtagagatgcagcttagcctcataaccttctaaaatcttttcggtccgcttgatgttatcatagacggcctggcgcgaaactgagaactccgctgcaatctcgcctaaggaatagtcatcagcgtagtacagttgaatataggctttttgcttattcgttaataacggttcataaaactcgaataacgaattgattcgataatttttttcaatttccatgtggggactcctcacgcttatcatacagactacacactaaataagagtaccgattttatcgccattcgtcaactatcagtcgctatttgtggtaaaaataaatggtaatcgtcctcgtgctgagaacaattaccatttcgttaactggctttcaatttaagaccatcatcaactgatttaacccgtgataatatctttaaataacccgtagacaaagtcattggcattgaatggtcgtaaatcagtcaccttttcacctaaaccaacgtactttacagcaagatgcaattcattacgaatagctaagacgatcccaccacgtgccgtaccatcaagtttagttaacacaatcccactgacatccgtcgactgtttaaacaacttggcttggttcagcgcgttttgcccagtcgtggcatccagcaccagtaagacctcgtgtggtgcatcagggatttcacgggtgatgacccgcttgatcttttccaattcattcatcaagttgactttgttttgaagccgaccagcagtgtccacaaagagcacgtcataatcttcggccttagccttcttaaccgcgtcaaagcaaacggccgctggatcacttttttcggccttagcgaccacgtcaaccccgtctcgttgcccccagacttgcaactgctggattgcaccagctctaaacgtatcacaagccgccaacaagaccttcttgccttgctgcttgtacatgttcgccatcttaccgattgtagtggtcttaccagcaccattgaccccgacaaataaaataacggttggaccactcttagccatgtgaatcgagttatcctcgccttcaccagcttcaccgtacatatcaacgagcttttcgacgatgacgcttgaaatttctttcttgctcttcgcgttctttaatttaacttcgtcacgtagctcgtcactaattcgcatcgcggtctcataacccacatcagattcgatcagcgtatcttccaaatcatcgaagaacgcttcgtcgacatggcggaaattagccaagaaggcattgatacgatcaccaaacgttttccgcgactttttcagtccttcatcataacgttctgcctcagttggctccggctcagccgattccgaatcagccgccgcattaacagtcggtgcggcggattcagtcgctgttggcgctgatgacttgactgctggcgccgtactagctactgattctgacatagcgttgtcttcaactaccgcatcagacttagtcgctaacgccacgtcgctcgcggccgcttgactaacttgtgccgcactcgcacttaatgcagctagtgactgggcaaccattgcactggctgtgagtggcgcttccgacaccgtcgccgattgcattggtgcttgtgaaccagactgtgcactcactgccgccgtgctatcggccggggcttcactagtagctgccgattttactgtcgctggttcgtccgcagtgcttgtcgcttcgcttacggctgtactggacaccggtgtcgcagttgattcagttgttgcgccctccgagcgagctaactgttgtgacgaaggggcccggtcgtcactgaccggtgcgttagcttgactcgtcgttgcaggtgcttcactggcagctgacgttgtttgagcgtcatctgattctggtaaactaaacgctttttttaaccgactaaatagtcccatcttcaacacttcctttaattatttttgttcatcttttaaatctgccaaggagactgagaccatcttggagacacctgactcttccatggttaccccataaagtacgtcagcgtgcatcattgttccttttcgatgagtaatgatcacaaactgcgttcccgtttgaaaatcattcaaatactgactgaaccgatccacattggcatcgtctaacgcagcttcggcttcatctaagatactgaatggcacggggcgcactgctaaaatggcaaataataacgtaatagccgttaacgcccgttccccaccagaaagtaaacttaatcgctgaaattttttgcccggtggctgggccatgatatcaaccccactggtcaataaatgttctgggtcggtcaagatcaattcagccttaccgccgccaaacatctgttcaaaaatcgtactaaattcgctagcgacttgatcaaatgccgttttaaagcgagtggcaacggtcgtatccaaatcagccattgtttgcagtaagtgttccttggcttcagttaaatcggaagcttggttattgagaaagtcaaagcgttccttgacccgctcgaattcgtcaatcgcgccgaggtttaccgttccaatctcatccaagccccgtttaagcagtttcaactgttctgtaatcgcaggtaacgctaagtcactgacgtcagcttgtgctgcggcaactgtcaactggtacttttcagccagatcagccgtggcgtggtcgacttcgccagtcaattttgtttggcttaattccaagcgacggtaatcatccgttgcggccgctgcgagttgttgcaaccgaacttgctgggtcgataattcttcaacctgatcattaagcgttgctagctgttgttcacacgttttccgttgttcttcaaccgcagcctgtttagccttagctgttttcaagaccgtatcgcgttctgcgaccgacatttgctggctcgctaacgttgttttaattgctgttaaatccgcttgaatttgctttttcgtctcttcattttgcgccaaggtcgcctgacattgttctaattgtcgttgcgtttgtttcacgtgttcctgcaacgtaatcagttgttcacgctgggcttgtaatttcgtcgtttgagtctgttgataactttcgtaatccgtttgctgttgttggactgttttcatttggtcctgatagtctttaagcttagccgcattagccgcttgcgcttgctgattacgagccactaagtcttcatagctatcatcagcttgcgtctgttgctgctcataagttaaagccttaacttgacgacttagctgtgtttgctcgctctgtgccgcctgtaactgggcctgtgtctgactaaggcgatccttaagttcacttagttgttggcgggtcgtttcaacctgaaccgtcaagtcttggttagcttttttaaggtctgctagcccttgttcataggttactaattcagactgcatctgggcaacattagctgcaattttttccgcggattgttgctgttggagtagcccattatcatcatggcgagtcgcaccaccggtgatggccccactggccgcaatcgtttcaccatcaatggttaccaatttgcaccgaaaacgtctgctccgtgaaattgccatcgcgtggtctagcgtgtccacaatcgccgttgttcctaacaagtaacgtttgattgccgtcaatcgtgattcacaatcgaccaactcgctagccacgcccaacacaccaggttgttgtgataaatcgcgctcagtgttaacgggaagttgacgagccgtgatccgctcgataggcaaaaaggttgcccgaccggcgtgattttgttttaagaaattaacaacagttttagccgtctgttgtgtgtcacaaacaatattttgcaactgtccgcccagtgcaacttcgaccgccttagtatactgatcaggaacggtcaggagttctgaaacggccccggcaacgccactaaactgttggcgatgttgtaagaccattcgaacgcccgcataaaagttcgtatagcgttcctgaacagcttgcaacgcctctagccgtgacttttcacgctgcatcaagccagccgcgtctaaccaacgttgctgttgctcgtcgatccgctctgcattcgtttttacttgggcttgttgggctgttagcgtggcctgctgctgattaacttgattttctaaatcacgttgctcacgattgtgcacgtctacagtcgtctgcacccgtttcaagttagcctgagcctgtgctagccgttctgctaacgctgtgctctgactgccagactgttgatgttgcttaacgaggttcttcgcttcgttattcagttcagcctgaacttgtttttcatcaatataagcattgcgtaatttttccagctcatcggccaactgctgacggccggccgcactcgttgccgtcgttaactcggcaacttgcgctttgactgccttaacttgggcttgctgctcagataatgtttgttctaattgggtttgttgctcggtttgcgtcgcaatctgttgctcagttgcggtcaaactggccgtcagccgttcctgctcagactgttggttttgccgccgttcagcgtcaaccccttgttgtccttgcgtgttttcgatggtcttaatcagctcaagattttgtgctaccagctcatctttttgctttaattgagctgtctgctgggtttttaaattagctagcttggttgcaccagcatcaacttgttgctgatacttagccactaacgccttggcactagctaacttttcattgacgccttgtagttgatcacgagcaatcgtcaacttcttaacgagccgcgaacggtccaaataatcaaatttttgtttttgatcttgataatcccgggcaagactcgcctgttcttccaacggccccttttgctgattcaactcagcaatgatatcgttcacgcggtctaaataatccgtcgtttccgctaatttattctccgtcgtgaacttatcctttttgtactttaggaccccagcgacatcttcgataatactgcggcgctcttctggtttcgcattaaagaccgcctcaacacgaccttgagaaatcactgaaaatgagtcttttcccagaccagtatcaatcatcaaattcgtaatatctttcaaccggcaactctgattattaattaaataatcgctgtcaccgttgcgaaagagtttccgcgtaatactaacttctgcgtaatccaaaggtaaaaagtggtcactgttatcaaacgtgatcgtgactttagccatattcaacggttttcgattagccgagccggcaaaaatgacgtcggtcatcttagtgccgcgtaaacttttgacggcctgttctccaaggacccagcgaatagcttcaataatgttactcttaccactaccgtttgggccgacaattcccgtcattccggcttgaaaatcaattttggttttatcagcaaatgatttaaatccgctgatttctaatgatttaagttgcattcgacacaaacttcctgtaattattaatggttacttttgctgtaattgtgaataagcttgccgagcagcgctctgttcggcttccttcttggaatgcccccagccctcaccgattttttgaccatcggcaagtacggcaatctcataagaccgctcattggctggaccatcttgttcaattaattgatagtcgattgcgacatcgccatcccgttgcaagtattcttgcaaggtcgtcttataatcaaaaacgccatcaaaacgaccctcatccagcttaggaaaaatcacttgatgaacgaacttcaaaacaggttcccgtccttgatccaggtacagtgccccgacaaatgattcaaaaatatcacataaaagtgaatctcgttcccaagcatgcgctttttgttcgcccttgcctaaccggatgtactgaggaaagtcacattcacgggcaaagcttgcaaaactttcttcacaaaccatggcggcccgtaaacgagtcaacttaccttggggcatgtctttataacgtttgtataaatattcggacaccactaactccaagacggcatcccccaaaaattcgacccgttcgtaatacttcaactgttggtcctgatgttcattgacatacgaggcttgtgtaaacgcctccgccaataaatcgggatcgttaaacacaatgccaaaccgttccttcaacattgcagctaattctgtaatcatttgaaacttcctttcgttatcattctatcgactaaccccattggatcagtcagttatcacaatctgttactggtggtgcctaacttagcatgaatcattatttaaggtggtcattcatctgccgttcgagcgcttccgacatgtatttagtgctactcttacacgcaatgttcagtctcacccagccgtggcagtcgaccgtggatgatcagaagctaacaaatagaaacacaagttaaaggtccgcttaagtaaggattcatctgataatcagtcagtcaacaggtcacacattgcatatcataacattatactatgatttagtggtcaataacaatgatatcggtactttcgtagtcagacaagcaaaaacaggtaaccatgttggctacctgtttttgcttggtcaattaacttattttgcttggtgcgctgccacgtaatcgacgacttcgccgaccgttgacaatttttcggcatcttcgtctgagatttcgctaccaaaggtgtcttctaattccagtacaaactcaacaaaatcgatggaatcagcatccaaatcggtttgcaagttcatttcgttggtaatcgttgctttatcaacttcgaaccgatcagcaatgatatccgcaattttatcgaaaatttcttctttcgtcatgtaaagatccctcactaacttgaattcactaaagtattctaatcgttttcagcaggaatgtctacacttgcttgctgattagcttgttgattagcaaaatattccgcaactcctgggacgatatccgtactgaccatctggcgaatttgacggatagtattcacgattgttggcgctttgctggaaccgtgcgtcttaacgaccggcgccttcaatcctagtaagaccgcgccaccgtactgagaatagtccatttgagaccggatttcattaaacccattcttaagcaataggccgcctaacttgccactgataccggtgttatagacggcatctttcactaaaccgagcatggaacgcgccgtaccttcaatgctcttcaaaacggcgttacccgtaaaaccatccgttacgacgacatcagcaaccccgttcaataagtcccgggattcaacattaccgacaaaattgataccgtcagtctgtgacaagagttcaaacgctgccttatggaccttatttcccttgtcatcttccgtcccgttattgagtaaggcgacccgtggatgcttagcttgcatcatccgttctgcatagtacgtccctaacacaccgtattgttgcaagttcagtggcttactatcagcattagcaccaatatccatcatcacaaagtttgattggttagcattgcgtaccactggcaataccgtcactaatcccggtcggtcgatgcccttgatacggcccacgataaataacccggccgccagaacggcccccgaattaccggcagaaaagaaggcgtccgcctgaccatccttcacggcctgagccgccattacgattgatgaatgcttcttacggcgaacggcacgtacgggttcatcctccatcgtaataacttcatcagcattgatgatttgaatccgatcacggttcttcagttgcgcgttaatcacgtcgcgttgaccatataataaaaagaccgtatcctcaaacaaatcacgagcctgctcgaccccctcgatcacagcgttaggggcgtaatcgccacccatggcatcaatcgcaattttaatcattgtgtcaccattcctctcatcacagtactgtatttaggttattaatcgagcgtccccaccgcagccaacttctggctcaaataggcggctagtgcccgattatccggttgactttgccaatccggttgctgcacgattgcgtgggcatcttgctgggcaacttgtagcacggtcaaatccgcaatcggatcacccactttaaattccggcattcccgattgcttgacccccagcacatcaccggctcctcgtaattctaagtctttttgtgccaaaacaaaaccatttgttgtctgcgtcatgatctgcatccgctcaatcccttgctggttcttgggatcagccaccaaaatacagtatgaagccttggtcccacgaccgacgcgtccgcgtaattgatgtagttgcgccaagccaaaacggtcagcatcataaatcatcatgattgtggcattcttgacgtcaacacccacttcaatcacggtcgtggaaacaagtaactgaatgtctcccgccttaaaagccgccatgaccgcgtctttttcctcaggtttcattcgaccgtgcaacagcccaactttaacactcgccccaaaatactcttgtaaattagctgacagagcctcggcgtttttaacatccagcgtctcggattcctcaatcaatggtgtcaccacataggcttgcgatccattgtcaatctgttgatgaacaaagcttagcgccgaattagcttggttgctccgtacccaagtggtttgaatcggttgccgaccagccggtaattcatcaatttcagaaacgtccatttcaccatacgccgtaatcgccaatgtccttggaattggtgttgccgtcatggctagtgcatcaggttgcccgcctttttgacgaaaggcggcccgttggttaaccccaaagcgatgttgctcatcggtaataactaatcccaaattagcataagtcaccccgtcctggatcagggcgtgcgtgccaatcaataagttgatctcaccagcagccagcgctgctaacaatgtcttgcgggcagctggcttggtcgcacccgttaacagtgcgacgttgacatccgtgtcggcaaagacctgggccaagttatttgcgtgttgttcagccaaaatttcggttggcgccatcaacgcggcctgataaccagcggtaatcgccgcatacatgacaatggcagccacaatcgttttcccggaccccacgtcaccttgaagcaaccgattcatatgcttcggtgacttcaaatccaaacaaatttcattgacgacacgtttttgggcgtgggtcaattcaaatggcagtgttttaataaacgcctttagtcggtcattgtcataagcgatcgcaataccgttcgtcgtcgcgtccgtttgcttcagaacttgcatttgcatttgaaacaacaagaactcctcgtaggccgctgagcgtcgagcggccgttgaatcggcttgactagctgggaagtgcatatcatgaatcatttggcgccgcggtaacagtcggtatttagcacgtaagttagcaggcacaatgtccgtaatgaccggggcatataactcatatgcttgtttgatcatcttctgaatcgtcccctgcttgaccgtcttgctggccggataaatcgaaccaaacgctgaatccgcattattgggattgatgatcttcattcccgtcaagctactgcgcgtggcgtcccacttgccataaacggctaaatcttggccagtctcaatctgtttcatcaagtatggttgattaaaaaaagtcaccatatagacgtcatggtcgattaataagcgaaaattcagacgattcttcttacggccaaaccgtgctagcacaggttcagaagccacggtaccctttagtgtcaccttttcttgatcggcgatttcattgacgtctttgacctgtagatcttcatagcgaaagggataataggtcaatagatctgcaatcgtattaatcccaagctccgctaaacctttttggcgggctgggccgacaccacttaaagttgcaaccgcgtcactcaactgttgtcccatgcctgaccaccgccctttctaaaataattgcctttaccaatattaattataccaaaaaaacgtttcaatcccgtgggaagtatccgtccgtacaaaaacaggccccagcatcactgctaagccctatttttaacggttagtcctattcaactgacacaaggaatgggtaaactggttggtcaccctcatgaatttcaatttctaattcatcatccaactcttgcaccttagctgccaaatgatcagcgtcagttttagttgcatccttgccgtaaataatcgttacgagttcgctatcttcgtcgagcatggctttgaccatatccaaagcagcggtatcgcgatctggattcgtaattacgattttgccatcaactaagcccatgtaatcatctttcttgatttcaaggccatcaatcgtcgtgtcgcgaacagcatgtgtgacttgaccactaacaaccgtactcaaggtttcttccatcgcggcctgattatcgtctaaatcagcttcagcattgaatgccaacattgcagtcatgccttgcgaaatcgtctgactgtggataattttaactgggacatcggcaacttccgcagcttgttcagctgccaaaaagatgtttttgttgtttggcaatactaatgcttgttgggcaccactgtcattaacagctttgacgatatccgcggtacttggattcatcgtttgaccaccagcaatgatgtcggtgacacccaagcccttaaatagcttgccgatcccatcacccgatgacacagagatgatcgcataaccatgcatgtcaacttgtggttgtgaaggtaaggcgggctcagcagcggcttgcgcttcgtcttccttatcatgttccatgatggtttcttgttgtagacgcatattatcaactttaactttgatcaacgccccaaaacgttggccccacgtcatgacatcgccaggatgttccgtatgaacgtgcaccttaacgatttcatcatcgttgatgacaagtaatgaatcgcccaattttgctaagtactcatagaaagtgtcatagtcgaacttgtgatcaactaacttaccatcgccgattcgcaccataatttcggtacagtagccatacttgatatcattcgggtctaattgcccctgcacactttgatggtgggcagcatcaatcatcgaatccatttcagcatcgtccggaacatagtcctgtgattcgtcgaccttgccgcttaatgagtcactaaaggcttccagcacgaaggtcagcccctgaccaccggaatcaacaaccccaacttgttttaaaacgggtaacaagtccggcgtggacttcaatgcagcttcagcagccgtaacgacggcatccataacttcacaaatatcatcggtcgttttaacagcttccttaccggcaccagcagctttgcggatgacagtgaggatagttccttcagtcggcttcataacggccttgtaggcggtctgagcaccggctgcgagggcggctgctaaatcgttagcggttaagctctccttatccgctacggctttagaaaagccccgaaaaatttgtgatagaatcacaccagaattaccacgggcccccatcaagagtcccttggctaaggctgacgctaggtcgcctacttttgtactggtttcttcacgttcatatttggcaccgctggccatcgataagctcatattagtcccggtatcaccatctggtaccggaaagacgttcaaagaattaataaattcagcacgttggttcagcttttgtgaagcagcctgcaccattttgccaaattcaagattagtaatcgtggtgattttcaatttcaaaattcctccttggcttccaccaacatcaatttagtcgttcattacccggacaccttggacaatgacgttgaccgaattggccgtaacgccaagcatgttttgtaagttatatttgaccttggcttggacattgcgtgagacttctgaaattttggtcccataactgacgataatgttgacatcaatagccaccccattatcctcttggcgaacaactacaccgcgcgcatagttttcgcggcgtaaaatttcattaacattatcacgaatctggttccgactcgccataccgacaaccccgtagttatccgttgcggcgccaccgacgaccgtcgcgataacatcattatcaatatcaatggttccaaattgcgttttgattttgacagccatgaaaatagcctccttgttttaacgcgttcatttacgatagtttatcatagcacaaccactcttgaaagaaaaattaagcgactgcttaacagaagcccggaaactgggaatttagcagtaaagtaaaattacttgatagaaatgtattgcaacctttattaatctatgataaattattctagtgaatgataaagacgaccttttatcaatgaattaccgaaggaggcagatcaacatggcaaaagactacgttacaggcaaacggacgcactttggtaacacgcgttctcacgctttaaaccacagccgccgcagctggaaagctaacttgcaaaaagttcgcattttagttgatggtaaaccaaagaaggtttgggtttcagctcggactttgaaatcaggtaaagttacgcgcgtttagcgcagcaaatcgccagcacatttttttgtggctggcgttttttgttgtctaaaatcactaacttctcgtcaactttttataaagtttataattcagccttgaccagcccattatgatgacctgaatcattgagggtgcttgccgtaccatcgtcggaaacaaccagctgggtctgaccaaaaagttctgcttcaacataagctttctggttaggcctgctaacgaccaccgacctaaacatcagcacgtttcaccaacaagcgccccgatgatacgtcgttactgcacattaaaagaccggttgatgagtttatgactcaccgaccggtcttattttagctgaaaccttggggtaccctacgcatccgccatgctgtcatcacgactttgaataacagccagaacccccgcatcaaagctaaagtgaccagtattgccactgaattcgttactggcccatgaaatcgggtacgcattataagcagcgtccaactgatacttttcatcgggtaacgtgagatgcatcggcatcagcggtacaaacgccaaatagcgtttatccgcttccttcgtgatctggtagtcccctggtagaaagaactgaaccgaattttgcttatcaatcagtttgatctgcggcgcccactgacgaaataccggatcaagtactaaccacatattggccagtaaatggtctaaccgaccacccgtggcaccatatagatgcactgcatccggttgcaactgctcgaaaatggatttaatcgccaattgtgtatccgtatggtcttggtcgggtttgacaacgacagcgcccaccaacgcatctttgacagtctggagttcagccgcatcaattgaatcaaaatcacctacgaccatcacgggctggataccacgtttcaccaaacgcaacgcgccacggtcagcgccgacccatggtcctggaatcgtcgttaaatctgctggataattagcggtcggtccgccaaccagtaagtttacgatggttgccattaattggtcgccaccttcaaatcttgaatacgttgcgctgggtccgcactgtcatagacatacgaaccagcaacagcgaccgtagcaccagcgtcatagcacgccttgacggtctggtcgttgattccaccatcaacttcaatctcaaattgataaccatgttgttgcttcaattcgttcaacgccgcaattttagcaaccatctggtccagaaaatgttgaccaccaaagccaggattgacggtcataatcaaaacttgatccactagtggcaataattcactaatcatgccgagtggtgttccggggttcacgaccacttcggctttcacaccagcatctttgattaattgtaaggcgtgataaatgtgacgggtactttcaacgtgcacaccaatcaaatctgcaccggcctttgcaaactgcccaacaaaccgctctgggtccataatcattaaatgacaatctaacattaatgacgttactggccgtaaatccgccacagtactcatcccgaatgacaagttggggacaaactgaccatccatcacgtcgatatgcaacgcatccgcaccggcattttcagccatctgaacgtcacgttgaaggttcgcaaaatctgcacttaaaattgaaggggcaactttaatcattagtctcactcactttttcttattatagattacttttttatttttaatggtttcatagaattgtaaataattatcatagcgacttgctaacagctccccagctgccaatgcctgtttaaccgcacattgcggttcgttaatatgcacacagcctcggtatttgcaatcagcgctaagtcgcacaaactctggaaaataatgggtcaactcgttagcgacaatatcgaaaacttcataggatgagaaacccggcgtatcagcgaccaacccatccgcaatcgggatcaagctgactttacgggtcgtatgtttcccacgattcagcgcctgcgagatttcaccagtcgctaacgccagccctggttgtaaatgatttagcagtgttgacttaccagcaccagtttggcccatgacaaccgccacatgaccagccagagccgttttaactgcggctaaagcagctggtgaaaatgcggttcgttcgcagatgacctggtaaccaatctgccgataagcatccgctaatgttaatcgttgttggtacacctcatcggttagtaaatcagtcttcgcaaagtatagtaatggttcaatacctgccactgccaaagctaccagttgtcgatccaataaattcgttgaaaattcttgttccgttgtggcggttaccacgatacctaaatcaacattagccactggcggccgtaccaactgggtctgtcgatcaagaatatttaacacgtagccctcttgtggggtcgccgcatcaaactccacattgtcgccgacaagtggcgtaatccgccgcttccggaaattcccgcgtgcacgggtccgatacatttggccatcagcataaacgtcataaaagccgcttagtgattgccgaatttgtccaactttcaaattagcaccaccttttatattatttggtacggtccacttttctctattgtaccaaaaaagtcatgcattgcgcatgacttatctttattttgttgcatttttgcttgtaatattcttcttttccatgatcgtaaccccgttacgcacgattcggtaatgccccttcgtattaccggtcagctgaaacggtaaactaatcttagtcgaccgcatgattgcaatatcgcgatagacggtctcaatcatatgggtatcatcatacaaataaatcttaacatcgttggcctgggcagtggtggccgataacgctttgtatggcaccgttagtttaacataaaaattctgtggtgtcgtcacgttattatcgctgccccttgacatggtcaccgtaatagtcgacccagtccggacattgccaccgccatctggatcttgatcataggaataacctgccttctgttccgaagagtagccctgcttaaagttaacattaagatcatttgcttcagcatagtccagaatgtcgctcttgctctcaccagttaaatcttttagctcgacgtagcgactaccagcgctgaccgtaaacgtcaccgtcgtatctgtcggcatcacgcgactaccagcgacaacatcctgactgatgatttgtcctgctgcaaccgacgacgtactgtaagtttccttaactttgaaccccgccgatttaagcgtctgtcgaacatcatggtaattatcattgacataattaccaaagctcataaccttggcaccgttgctgataaccaaattaatgcgagcacgttcttggacccgcgtcttaacactgggcgttgatttgatcacctgatttttggctacctgattacttttagcatgttgaacagtcccgaccgtgagatggtgttttttgaggaccttagttgcggcacgctgacttaagcccgttactttcggcaccgtcgtcatctgtggccgacttaattccaaaccgacgatcacggccacgactaataacaaaataataccgccccaaaagaggagccgacgccgcaacggatgtcgtttggaccaagaacgtgttggtaacggttcttcatcagcatctgtctgactctcagtcgtttcagccgggcgctggagtgttggttgcttgcttttatgcgccacgacctgggtcttaccgtcttgattggccgcaattgctgcttgaatatccgcactgggcatgatcttagtctcatcattaccgacatcttgcggtacaaagcgcttttcgcccgcacggttactagcaagcaccgtcaataagtcagcggccatgtcctcgaccgtagcataacgttcccgtggatctttcgttgtcgcctgcaagacgacgttttcaagtgcctgcggaatatccgcatcaaactctcgcacggatggcattgcattttgaaaatgctttaacgcaatggaaactgccgtctcacccttgaaaggaactgagcctgttaacatctcatataaaataatccctaacgaatagatatccgattgttttgtcgccatgctaccgcgggcctgttccggtgacaaataatggaccgaacctaaaatcgtgttagtctgcgtcatggtatgttcagataacgcgaccgcaatgccgaaatcagtgattttagcattgccctgctcatcaattaaaatattttgtggttttaaatcccgatgaataatattatgcgcgtgggccgttgccacggcacttaatatctgctccatgatgtcgattacttgctgtaacggtaacggaaagttctctttaatataatttttaagatccatccctttgacgtattccatgaccaagtattgcatgccattttcttcgccaatatcgtacaaactgacaatgtgggggtgaacaagttccgtcgttgccagtgcctcacgttggaatcgcttgatggtcttaggatcatcacgtaagtctaaccggagcagtttgaccgcaacatcacgatctaatattaagtcatgtgccaagtaaacgttggccatcccaccttcacctaaggaccgaacgatccgatatcgtccgctaagggtatagttgggtgtcatttactggccacctcaccatcaagcgccatcagcagcgccgtaatgttatccttaccaccagctgcattggctaatttgatcaacgtctcacacttctgggtcgaagtctgcgtcgttgccaaaaccgtcgcaagctgttggtcagtcaccatattcgtcagcccatctgaacataataacaattggtccccaggttgtatctggtaaaggttcgtatcgatatccgcatctggtgagatgcctagtgtccgcgtaataatatttttctgcggatgttgtcgggcctgttcggctgaaatctctcctcgcttgaccaactcattgactaaagaatgatcctccgtcagttggtggagttgcccatcgcgaaaaagatagccccgactatcaccaatgttagccatcaaaaacttttgatcaaaaagcaaagcggcgaccattgtcgtacccatgccgtttagatctgaaaattcacgggccttttcaataatatgctgattttcatcttgaacttcacttgctagccacttgacggcatcattgggttccttgaatgttgtattttcaaaccgaaaacccatgtgcgagactgccatctcggaagcgacatcgcccccctggtggccaccaataccgtccgcaacaattgcaaaattgatgcccgctttattttgaaaaaagccgacatagtcctcattttcttcacgttgttggccaatatccgaccggtatgcaaaatccattgtttaccactccaccattatttttttcgcaaacaagcaatgaaaaagccgtcggataaataatcatcgggataaatcgacaaagtcttttccgttcgatcagttttcaagtctcgttcagttggcgttgtttgcagctcaaaatctgggtgatccgctaagaatttggtaatcacatcctgattttcctgttgcaaaatcgtgcacgtactatacgtcatgataccaccttttttcaaggttggggcgaccgctgtcaaaattgccagctgaattcgttgcaagttcaaactatcctgcaactgtttctcatagcgaatctcaggcttccggcgcatcaatcccagtcccgaacacggagcatcgactaaaattcgatcaaaactttcagcattaaactgcgtctcaactttacgggcatcgagttcggtggcctcaacgcgatcagcaacgtgcatgcgcgccgcattttgaccgatcagtttcactttattggcatgaatatcaagggcaacgactgtgccaccctgctcagcatctaaactagccgcaatctgggtcgtcttgcccccgggggccgcacaagcatccaagactcgatcattcggctgcggattgagtgctggcacaactaattgtgcactttcatcttgaactgtgaacatgccataccgcatcgcttcagtattaatggcctgaccatccgttgcaatcagccctaacggtgagatttcactcggcgtaattgtcaaaccatcattaatcagcgccgttgtcacatcttcaaccgtcgacaaggccgggttgacacgtaaggcttgcttagctggttggttcaatgatgataagattcgctccatcttttcagcacctaattgacgccgcaattcttgaatcaaccatattggcatgctataagtcacactcaaccgttcatcaggatctttaatcgcatcaaaactcggtagtcctgagcgatccatttgatgtaagacgccggttacaaaccgccgaatgccagggtgacctttgaccttagcaatttcaatcgtttcgttgaaaacggcccgttgtggaatcttatccagatactgccattgatacaatgcgctcaataagagctcccgtacccaggggtcaatctggtgcggatgtcgaacaaacggggtcaaccagtattcgagagtcaaccgatgttgaatgacaccgtaaaccatatttgtcagcagattaatgtcacgccgatccatctgatgatcattgattaactggtttaattgcaaatttgaatatgcaccgttcttaatcttcgctaaggcggcgaccgctaaccagcggggggtattaccaactgtactcatttattaataacctgctctccggtagcgaacttatctgccgccccatttaaatagtctgtaattgtcatcttcggtttaccagctggctgcaactgattaattgcaatcgctgtgtggtcagcagctgcaatcacaagctcatgtttcgtcttgcgaaccacttgtccaggagcttgcgtgaccacttcgtcagctaagggggtcacatcccagaacttcgtgcgctttccatccaagaccgcataggcgattggtgctggccgcatgccccgaacttgattatcaatttcaacggccgtttttgtaaagaagtctaagacctcttgttctggctgaatgttcggtgcaaaggtcacttgggattcatcctgtggcaccgccgtaatttcgccagcaatcaacttgggcaacgtttccagtaacaagtcgcgaccaactaagctcaacttatcaaacatcgtcccggtgtcatcgtttttttcaattggaatcgcacgctgcgccagcatatcgcccgcatccatctttttaaccatgtaaatgatagtaattccagtttcagactcaccgttgataattgaatattgaacaggcgcaccaccacgatacttaggcaacaacgagccatggacattaacggcaccaattttggcagctttcaacaattttgttggtaaaaactgtccaaaggcggccgtcacaattaaatcgggctgcaagtcaataatctgttgcatttcaggactaccactaatcttttccggttggaagacgggaatatcatgggcaaccgcgacttctttgactggcgaagctgttaagacgtgtttgcgaccaacttttcggtctggctgggtcacaacgcctagtacctggtattgttctttaattaaactttcgagaatcggtgccgcaaacgcgggcgttcccataaaaacgattgatgtcattgtcaaacttcctcctaatcccattacatgaaatgtaagggttccacgtcaattccaatctgtagcccttgtcgttgttgcgcctgcgtctcatgcagtagcgttgtcagcgtctgagctaaattgggttcttgtttatatttaatcacgatttgataataataacggcgattgactcgtgcgatcggcttgggcgttggacctaatagaatcgttgacggtgccaaccgcgggcgtaaccattgcaataactgatacatgcgcttggccgctaccccttcatctaagtcactcgctgtaatttgaaccgtaaagtagtacggcggatagccccccccggtgccgcatctgcatctcatacttgaaaaagccttcgtaatcgtggtgttgtgcaaaccgaatcgcataatgatccggattaaatgtctgaatatacacgtgaccactcttttccgcccgtccagctcgaccactcacctgggttaatagttggaaggtccgttcactggcgcgaaaatccggcaatcctagggccgtatcggcattcaagacgccgaccaaggtcacattaggaaaatccagtcccttcgcaatcatctgggtaccaatcaaaatatcagcttcaccactcccaaactgtgctaaaagcttggcatgggcgccctttttacgggtcgtatcattgtccatccgaataatgttagcgtccggaagcaagtcttgcaattcttcttcgactttttcagttcccgtcccataataacggatctgacgactatgacagttcggacaattccgcggaatggcttcttcgtgaccgcagtaatggcacttcatcgtgtgcgtatccatgtgtagcgtgagtgaaatatcacaattaggacacttcaagacaaaaccacaatctcggcacaacacaaacgatgaatagccccgccgattgagcattagaacactctgctcatgacgttcaagccgatcctgcaaggcaactaacagtggcgctgagaaattgctttcagcgtgttgttgcatttcctttttcatatcaataattgaaaccttaggaaggggccgtcgattgacccgatccgcaagcagtaagcgctgataaacgcccttttctgcgcgggcgcgcgtttctaacgatggggtcgccgaacccagtacgactggacagttatggtaacgactacgccataaagccacttgccgagcatgataacgcggggcatcatcctgcttatacgtgctctcatgttcttcatccatcacgattaagccaagattttttagcggggcaaacaccgctgagcgtgcgccaaccaccacctgagcctcacctcgttggattcgccgccactcatcatacttctcaccactggacaatccactgtgcaaaacggcaacagctttaccaaagcgacccttcacgcgttgaaccatttggggtgtcagtgaaatctccggcactaacatcaacgccgtttttccttgtgccaatgcggccgccatcgattgcaagtacacctcagtcttaccgctccccgtcacaccctctaacaagaacgtggtggttgcggcttggtcaacggcttgcgtaatctgatcgacggccacttgctgttcatcattcaattgtaacgccttggtagtcttaatatcactagttgcgtagggatcacgataaacctcgacggccacttttttaagccagcctttctgtactgctgtacgaatggcaccgtccgtgacatcaaaacgagtacaaaacgccttttgcgagagctgttcaccatttaaagtgagcaatccctggagcaccgccaattgttgtgtagccccggcgcgtacctggtccactgcagcctgtagcgcttcgttagttaaggccgctttcaccgccgtttgcgttttacgccgtgcttgatttttaacttggtagtacacatcgacttgcccagccgcctgcagccgtaataactggctgacgattgccggcgtcgtggcgacgtcatcaaacggcaccatcgattggtccccaaacagcgtcgttcgaatcgtcgcgggcgttgttgctgttgttcgcaactgtttttcatactttgcacgcatgaccgccggcagcatggtctgtgcacaggtaatctgaaatgaaaacgtgctggcagccaaccacttggtcagtgctaaggcttcagtattcagaaccggtgctaggtcaacgaccgcgtcgattggtttcagctcaccatcaaagttagtaacgtcatcaagagctaacacaaacccctgcacccgccgtttaccacggccgaacggcaccacgacgcgcatgccgggttgcacttgtgattgccaggcggttggaattcgataactataaggtcgatttgtctgcatagtgggcacatcgactaatacttgggcaatttgtgccacacaactcttcctctctacttaatcatgcctgtgttcctgcaccatccgcaattgccgtcatcaagatctgtttggcaattgcagttttcgttgtcaattccgtcgtaactggttgttgctcaggccgcaacagtgtgacctgattggtatcaccattgaacccaactcccggtttggaaacatcgttagcaacaattaaatctaattttttactagttaacttacgattggcattggccagcaatgattgagtttcagctgcaaagccaatcacatactgttggtgcttccgggccgctaacgtttttaaaatatccggtgtttctgtcaatcgtaacgttaagtcagcatggtcagctggctttttaatcttctgatcagctaattcagccggccgataatcagatacggccgccgccatgaccaagatatccgtatcatcaaaaatatcactgactgccgtcaataaggattgagccgaatcaaccgtcacgaccttaacaccactaggcgctgctaaatgagtcgtggcgctgatcagtgtcacagttgcacctaactcccgtgcgacttgagcaactgcgtagcccatcttccccgatgaacgattcgtgataaatcgtaccggatctaaggcttctcgggttccgccggcagtgacgacaactcgccgtcctgctaatggcaaatcaggtgtcaactgaatcagttgatctgtcaaccaggccaaaatcaccgctggttccggcaagcgtccttgaccactgtagccttccgccaacatacccgtagcaggagttaagacgtgtaacccatccgtcgtcagttgcttcaaattgcgctgagttgctggattagcgtacatatgtgaattcattgctggcaccacaaacttgggtgcggtcgtcgctaaaattgtcgtcgttgcggcatcatcggctagaccgttagccaccttagcaatcaagttggcggtagccggaacgagaatcatcacttcagtccagtcagctaacgcgacgtggacgacgtgatgcgggtcagtcgttgtgaactcatcaatgaccactggctgctgcgttaaagtttgaaaggtcaatggcgtgataaactttgccgcatgggtcgtcatcgcaactcgcacgacggcgccctgtttcatcaaactacgaatcaatactaacgctttataactcgcaatcccaccactaacgactaccgttacatggcgttttgtccatatactcacttcttcacgtcctttgaaaaatctcgcaatcgtgccagcgagatttttacactttaataaaacaattgtatcaagaatcgacagtaacgtgaagctgaacgtccgcgtcattcttcataaaaaaagtgccaagccccagctggctcagcacaccgttttgttactaatctttgtcagtttcatctggatcgatcattaagtcaccggccgcaatttcttccatggcccgaccaatcgttttaaccgatttgtattcgctaagcattggtgctgcaccagcgtccaattcatgggcccgcttgctagctaacataatcaatgagtaacgcgaattaacttgcttcaataagtcatcaactgatggatataagatcatgattccgcatctcctaacatttcttcatactcgggcatgacccgtttaacactaaaccgttcactacgaataatagccttgattcgttcagcagctagcgggacttcatcattgataaccgcataatcataattacgcatcatcttgatttcatcaaccgcttttgccatccgcttgttgatcacactcatatcatcagtcccacgaccaatgatgcggtgcttcaattccatcaaatccggcggcgtcaagaaaatgaagacgccatcaggcattttttcgcggacttgcatggccccgttaacttcaatttctaagaaaacgtctttgccagccgccaacgactgcttaatatattttaagggcgtcccatagtaattgtcaacatacttggcatattcaagcataccgccgctcttaatttcatcctcgaactcttctttggacacaaaatagtagtccttgccatctacttcgcccggacgcatttgccgcgtcgtcatcgagactgaatattgaaaatcgttatcatctgagtcaaagatttccttgcggacggtacctttaccgacacccgaaggacctgataagacgattaacatgccttgtttcgccatgatcacaaattccccttaattaaaatatgttttaaagtttattttgcactttttaaccctatattgcaagtattatcaaggttacacagctttttttcatttttattcgtgaattttctcaaattttaggcttgctttttagaacgcctgttcgtataatggaaacacaaacaaatgttcgaggtggctaatatgcaaaatcaacaatctaatttgaaactaatttccaagaacttacacgcttcctatcgccaatttatggatgactttactgctgccccgaccgtcgttgcgccgttactgccaatgatgccggctttccagcgggatttgttcttagctcaagcgcacacggaacactatcaaatcatgctccagatgcagcctcagctcactgagtcccgaccatataatattcacggagtgttaaaaaccctcgctagtggtcagttggttctagttaatcggcagttacacctgacccacttggtcgacccggacgccatccgttatatcaaacgcgtttagtttaatcattaatacttgcatcaaaagatgaaatcatgttcaatacaaccttgcgtattctcatggtgtttttgatgcaaatcaaaaagattgatgttacagctccactgacttccctgaatgagtgagtacggagtacctgtaaatcaatcttttttagtaacttaatttttatattgcttcttttacttgtcgctcactgacgttatttttgagttggatcagcacgcttttcaatccaagccaagaccgtatcagcaatgattgccattaaggctgttggtaacgccccggccaagataatggcaccaccattcgtagcattggttcctcgaataatgatatcccctaaaccgccggcaccaacgaaagtcccaatggccgtaatcccgatagccaacactaatgcgttccgaagtccagccataatgacggaaagtgacagtggcaactccaccattcgtaacaattgccaacgtgtcatccccatccccttaccggaatccaaaatactagcactcacattttgcattccagtataggtattcttgataatcggtagcaatgcgtataaaaagaccgtgacgattaccgtgttcacacctaggcccaaaccaatcatgatgattgataacatcgctagtgacggaatcgtttgaatcacattggcaatcgcgatcactgtcgcactcaaccgactatgatgggcaatgaaaatgccaattggaatcccaacaattgccgcaaacagcacgccataaattgaaatcaagaagtgacgtgagaactggcttaacacgtacacaccgttttgttggtaataatatatcaactgttgcagtaagttcatctgagccattatttgtcactcccttcaaagtaattatgtttttcaaggaactgtttagccacaacttccggttccactaagttattatcaacttgatagttcaagttttgcatcgtctttaagctgattttaccgtttaatcgattcaagattggcttcaacttcggatgagctttcaagattttgttcgttgcaaccgcactcgcattgtatggtgggaagaaattcttatcatcctttagaatcttcagatcataactaccaatccgaccatcagtcgagtatccgaggatggcatccattttacctgattccaaggcatcataaactaaaccaatttgcattggataagtcttcccaaattgaaagccatacaacttcttaaaggcaggatagccgtcaccttttcgttcagtccagatttgatccaaaccgaccgtcagcttcgaggctacttttttcatatcactaaccgtatttagatggtattttttggccgtcgctttcgtcaccataaaagcataggtatctgcgaacccataacttgggaaataggtcatttgatacttgctgttgaactgtgagcgaactttttggtcaatcgacttgatattactccgatccatcttttcacccagaatcgtcgttaaatccgtcccagtgtaacgaatcgctgaaatatcagcctgatcattcttcaaagcattgaaactaaccgtcccagaacctaaattgttaatgatcgtcgtattcaaattagaataatgcttaatcatatcttgaatcatgtacgccatgatctgttgttcagtcgtgttttgtgacgcaatccggatcgtatcggatgaagttcctgacaaacccggaaagccacagccggccaataataacgcactggcgaccgttgcgaaaacacctaacaaccactttttaattttcttcatctttaatcccccttacgcttgtgtggttcttggggtaaccgctgcttctagtttacccaacagccaatcaacgatgagggctaagataatcactggaatcgaaccgcctaaaatcaagtcagttcgatagaggtttaacccattaaagataaagtccccaaggccaccggcaccaatgtatgatgctaacgcggcccaggcaataacgtacgttgcggataatcgaataccagccataataactggggctgccatcggtaactcaactttaacaattgactgccaaccggtcattcccattcccttagccgcatcgatcaaggccggatcaacgtcttccagtccaagataggtattgcggagaatcggtaataaagaatagatgaacagcgcaatgatagctggaattgcaccaatcccgaaaaacgggatcatcaatgccaacaacgccatcgctgggatcgtttgcaacatactagcgattgacatgaccacattcgcaatcggcttcacccgcgtaagcagaattccaatcggaaccgctacgataatgcctaagaacaatgaaaacgccgaaatatacaagtgttgccacgtcttaaccagcagctgcatgccgtagttttgtaggaaagttatcatgcctgttcaccgccttcagcgggcgcatcgtcctccccatgatgaatattattttcagcttcatcttcgtcttcatcaccccagagagcatcataaacaatatcgactagggtggcccgcgttacaattccgaccaggcgatgttgttcatctacgactggaatgttcttcaagccgcgtttcaaaatacgttcgaccgtatcccgaatcaatgaatttgactgaacatagaacaaatcagtcttcataatgtcgcccacactagtagccgagttaaagttgtaatcaacgtcttcaatgccgatcacacccttcaagatgccggcttcatcggtgactaacaacgagtcaacgcgtttatcatgcatttgtcgtaatgcgaccgtcaatgactttcctggtgtggtggcaattggatctttcaacatcacttgcccaacagtggtaatacttggccgtgcttgaatcaagcgatccttaccaattaagttctcaacgaattcattagctggatgacgtaagataccgtctggcgtatccacttgcataatgtcgccaccatccatgattacgattcgggtcgctaattttaacgcctcatccatatcatgggttacaaagacgaacgtcttacctaagcgttcctgcaaatccttaacgagatcttgcaaagattcacgggtaatcgggtctaacgccccaaatggttcatccatcaatactaaatcttggtctgctgctaacgcccgaacaaccccgatccgttgttgttgcccaccggaaagctccgacgggtaccgatccaagtaatcttctggcaattccaccagcttgatcatcttcttagcacgttcattcattttatcttggggccactttagcaatcgtggtaccaaagtgatattgtctcgaatcgtcatatggggcattagcccaatgttttgaatcacataaccgatttgtcgccgtaatttaaccgggtcaatctggctaatatccttaccattaagtttaatggtaccggaagtctgacttaacatccgattaatcatccgcatcgtggtcgttttacctgaaccagacgtcccgatgaaacaaacaaattcacctttttcgatttccaaattaaaatcttcaacggctactttgccaccaggatacgttttattcaaatgttccattgtcagaaacaacctcatcactccaatcatttactcagtttatttcgttgccgaataaactgtactgtaattaagcataacttataacgaaagcaaaatgcaaacgtcatgacatgtaaactgaacattttatcgttttaacggtatattttggtagtcggagcttcagattagccacccactaccaaccagcccgacagttcattaaaacgtgtccgttgacccatatttcgtctatttgcgttttatattgtaaagaattatcgccgccttggcaataataccgaaacctcactcgacactatcgtcactaattaacaccatcaaaaaaggaccgaccatagttgtccgtcccttgtggtaccgatcaattaagcttaatcatctttttcctcatcggccagtcgcaataactcttccgcatgttcaagcgataacttagtgactttagttcccgccaacatgcgtgccagttcttgaacccgggccgcattatccagcttagtcacactcgttttcgtgcgtttaccagtaatcttcttggcaatgaagtagtggtgatcactcatcgccgcaacctgtggcaaatgggtaatacagagcacttgtgaaaagtgtgcaataccattgattttctcagcaatcgcttgagcaacccgaccgctaacgcccgtatcaacttcgtcaaaaatgatactggtaattccctgtgattcagaaaaaatggttttcaaagccagcatcatccgtgagagttccccaccagacgcaattttagccaatgggcgcatgcgctcaccaggattagtctgaatataaaattcaacactgtccagaccactccgatagatctgacccttagtcggtttgaatcgtacttcaaagattgccttatccatatacagatctttgagttcttgatggatctgtcgttgtaatactttcgccgcagcccgccgtttatcggacaacgcttcgcccgtcgtaagtagttgttgtttcagatcggcgacccgctgggccaaatcttcactattttcttcagagtcagtcatcttggctaactcagccgcgattttttggtaataatctaagatttgttgttcagagtccccatacttacgttttaactgggccaaaacgtccagccgctgttcgatttcatccaagcgaccctcgtcgaattcttgcaaatcgagctgattagaaatctgaccggccgcgtcctgcagcccataaaaggcatttttgacattcacggtaatctcattaaaggcggggtccaaattagcaatcggttctagtgcattcatcgccgtaccgaccatatcaaccgcaccagtcgtctcctcacctgcagctaacaatgtgtaactctgttgaagcgcttgattgatcatttggtaattatccaagcggtcacgttccgcagtcaaactggcctcttcacccactttgacttgtgctgctgcgatttcgtccacttgaaagttcagcatatctaagcgttgagcccactctttttcattcgcattcttttgccgcagttcacggtttaactgctgataacgatcatactgttgctggtaacgctgcttcaatttacgaattttagcggtggcaaactcgtccagcaatcccaggtgtttttcaggttgcatcaactcttgatgttcattctgaccatgaatatcaacaattgtttcaccaatctgtttcaaagtcgtcgtattgaccagcataccattgatgcgacatgtattacggccacttttagtaatctcgcgctgtagaatgacggtattatccgcatgttcgatccccgcttcgtccaacaattgggccgtcacgccgtcagccggcaaaataaacatgccttgcaaaacggctttatcagcaccggtccgaataaactctgccgagccgcggccacccgctaataaaccgactgcatcaataataattgacttaccagcaccggtctcaccagttaaaaccgtcatgccggcttcaaaagcaatgtctaagtgttcgataattgcaaagttcgtaattgataattcttgtaacactgcaagccctccttaaaagcaattggttaccagcatccgttagttaattttgaaaaaaagcgacctgacacacatgtgagcaggtcgaagatagcttactaattagtgatcactcagtaagcgttgaattttttgttgtagctctaaagtcatcgctaacgacttgcaaataatcagaacatgagcatcatcgcctagcgttccaaaaatttcgtcataatgcattgcttcaatcaacgttgctagtgctggtccgttacccggcaacaccttgatgaggacaaatttatcctgagtcgcatacgagacataagcatctttcagtgtccgcttgagctttttctccgtatccatttgtttctgaactggcatactatagtggtaaccgcccgttgccgagggaaccttgaccagctgcatatctttaatatcgcgcgaaatggttgcctgtgtcacgtcaatatcttcagcacgtaacagcttgacaaagtcttcttgacgttcaatttcgttcgaactcaataatcgtttaatgtagcgttggcgctcttgcttcttcacccgatcacccccggtagctattcatacttatttaaacacatcataagccaaaatgcataaatatgaaagtccggatttcaattttaagcttgatttaattgttcataagcggccgcctgagttttttcaatcgacacagtcggcgcaatccgtggtgtttcatcggtagcttgtaaatgaattagaaactcaatattaccttcaccacccttgattggtgaataatcaagccctagaacgttataaccattcgcttgcgcaaattccacgatatctgtcaacaccgcctgatgaacagcaggatcacggaaaattccgtgtttgccgacattctcacggccagcctcaaattgtggcttgattagggcaacgactgaaccaccgttttcaataatcgcgtgtaatgggggcaaaattaagtgtagtgaaataaatgaaacgtcgatggacgcgaagttaggttgcccctgcgtgaaatctgccagtttactataccgaaagttagtatgttccatcacaaccacgcgcggatcttggcgtaacttccagaccaactgattactaccgacatccaaggcgtaactcatttttgccccattttgtaaaaccacgtcggtaaaaccaccagtcgacgagccaatatctaggaccgttttgtcggtcacgtcaatttcaaaacttttgagtgctttttcaagtttgagaccgccacgtgaaacgtagggcatcggtttgcctttcaaatgtaattcagttgccactgggatcttcatgcccggcttatctaagcgttcttcgttgacacctaagatttcaccggccattacggcacgcttagccttttcgcgggtatcaaataatccttgttgtactaataatacgtcaactcgttctttttccatctaaatttaagtccttaatctgtaaaatacgttagaaaagctgcaagcaagcccatgcctcgttgactagcagcactagcttttactaacgccgtttgagcagctgttaccgcttgttctaacgctgttcgtgcgcctgcaagccccagcaaacctggatacgtattcttatgctcatcggcatccttatgcgtagcttttcctaactgagcaggcgtactcgtcacgtctaaaatatcatcgtaaatttgaaacgccaatccataggcatcagcatattgtaatagcaattcctgcacggttggttgcacttgagcttgaatcaaccctgcctggacagcgtagtgaattaacgcccccgtcttctcgcgatgcagctgttgtaaggctggcaaagccagatgttgtcccgctccaaggacatcagcaacttgaccagccaccatcccgcgaggtccggtggcctgcgctaatgctaaggtttgattagcgacgatcgatgccggtaacccactatccgcaatccattcgaaagtcaacggttgtaaagcatcccctgcaagaatggcaacgtcttccccaaacttaacatggttagtcggttcgccacgtcgtagctgatcattatccatcgccggtaaatcatcgtgaattagcgaataagtatgcatcaactcaacggccacacttgcccgcaagtttgcagccgtcgttgtgatatcaaaagtatctaaaatggctaacgtcaataacggccgtaaccgtttgccacctgctagtaccgaataacgcatggcgtcagtcagggttgattggtcagaacacgcttgaagctgctcatctaaatactgattaatctgaggacgccacttggattcaaattcagttaataattgcttattcattggcgtcagcttgctcaaatggaacttcgtcgccattttcattcatcatcttagtgagcgtcttttcagcaccttcaagggttgcttgcaactgcttgctaagtgccacgcccttttgaaattgatccaaggcttgttctaaagggacatcgccttgttctaattgattaacgatcgtctctaattgtgataaattctgttcaaaagttggttgttcagccattattttcctccatcaatcttcgtaatctgtgcctgagcctcaccatcagccatgtgaattgcaaccgtttgttctggctgcaattgtttgaccccgtgaaccacttgttcatccgccgtcacaaaggcgtaaccacgcgtcatgattttaagcggactaagtagatccaacgattggacggtctgcgtcagttgttgccgtttttgccgcacgactaactgggtaccccgattcagccgttgctgcaagttaagcagttgcgtttgtgcctggcgaacttggtgaatcggcgtttgctgtcgtaattgttgaaaaacacgctggtagtgctggcttgccagattaaagttattttgaccagcctgtttaagtcgctcatttaagaagtctaacttctgcaaatacccttcgtacaagcggttcggctgagtaaacacgtacgacgtttgtaatttattaagtcgttgtcgatcgcgttgaacgaaattctgaaatgcattgaacacgcgggtctggtcttgctttaattgtaataaaacatcgttatatactggtaccgctaattcggcagccgcagttggggtggccgcccgcacatctgcgaccaagtcagcaattgtcgtatccgtttcatgccccacggatgaaataactggcagttgactctgtgcgattgcacgcgcaaccacttcttcgttgaatggccacagatcttcgattgaaccaccaccacgcccaataattaatgtatcaaaatcaccttgcgcattggcacgttcgatctgccgactaatttcggccgcagccgcatcaccttgaacttgagatggaaacaaaacgatctgcgcaatcggaaaacggcgccgagtagtcgtgataatatcgcgaatcactgcgccactacgactagtgaccactgcaattcgctttggaaagcgcggaagcggctttttgggtgcactaaacaagccctcagccgctaatttctttttaagttgttcgtaggcttgatacaacgcacccacgccgtctggttccatgcgttccacataaatctggtaactaccactgggctcatacagaccaatccggcccacgaccagaaccttcataccttcttcaggctgaaatttgaccttggcaaacgccgacttgaacataatggctgaaatcttggcatggtcatctttcaaactgaaatattgatgcgtattaggccggggacgataattagaaacttcccccgttaggtacactttacctaaatacggatcaacctcgaatttacgttttaaatactgagttaaagctgtcactgtcaaatattgttgactttcactcacttacatcactccactttgcaagttccaccgttgtctgcatcaaggtggcaatcgtcattggacccacaccaccaggaacgggcgtaatcaaccctgcgatgccttgagcagaatcaaaatcgacgtcacccactagtttaccattttcatcacgatccatgccaacatcaatgaccgtcgcgcctggtttgatatcagcaccagtgatcaggtgtgcaatccccgttgcaaccaccaagatatccgccgtccgggcgaccgcctttaggtcagctgttttactatgtgcaatcgttacagttgcgttagcatttgttaacaaagcggccatcggcttaccaacaatggtactccgaccaataacaaccgccgttttaccagccggatcaaccccatagtcagccaacatcgtcataataccgcgaggcgtatttgctacaggataattacctggaaaattggtgatcaacttaccaacgttcgtcgggtgaaaaccatcgacgtcctttttaggatcaatggccatcgtgatcaatggttcattaatttgggctggtagtggcgactgcaccaagatgccatgaatgctgtcatccgcattgtatgccgcaataatggctaacagttcgtcctgactagtagtcgctggcaactgccgcaccacggagtgcatccccaacttagtggctttacgattcttatttcgaacatagatttgactggctgcatcgtccccaacaataattacagcaatccctggttgaattccctgagcagccaattccgctactgccgttgccgtctgcgcgttaactttcttagctactgccttaccatcaataatcttcgtcacaagtgccacactcctctttctctgtctggtcttattttagcatattcaccacaatgatttatgaccggtttactaataagttattaaaaaaagtctggcaaatcgccagacttttacggtagaacataagattgttcggttttagactaattggcttggtttttaaccactttaccaagcaccccgctaacgaatttccgagagcggtcatcactgaacgcctttgtcaattcaattgcttcattaaccgcgaccttagttggaacgtcgtcaacaaattgcaattcaaagaacgcgatgcgtaagataatcaaatcggtcttagccagtcggtccaacgaccacttctgacttaaataaggctgaatttgagcgtctaattcaacttgatgttcacgaacaccagttactaacgtacttaaatatgcgggaatttcaactgcatccgcttcttcagggttgagtaactgttggaacaactgattttcatcagcgtctgggttagcattcaacgcgaataaagcttgaaatgctttttcccggatttcatgacgcgttaaactcacgattcttcaccatcttcattttcatcggtctgggtatcttcatcaccaaacaagttgtttggatcaatggcactttcagtcttctcagtcacgataccagtgatgtggacattgacttcacttaaggcgaggtcggtcataaataagatttgttgcttgaccttatcttgaatcgctaaagcgacttttggtaccgaaacaccatagtccaagtatgcgaacacatcaacactaatctgatcatcgacgattgttaacttgacacccttaccaagattcttcttgcgaccgaacaactcatttacactggaagaaatcgtcccttgcatccggttaacgccatcaatttgacttaccgcgataccaacgattatttcaagcacttctggtgcaatttgaatttgtcctaagctgggttctttgctttgtaacgtaatattgctactgtcagccattttgacattcctccaattccatgtttgccggtattagtttttctaaaaattaagcccgtgaaacgtacgtggagtcaacggtgttaacgatcagcttgtcaccggccttaacgaagaatggtacctgaataattgcaccagtttccaacgtagctggcttggagccaccggaagcggtatcacccttaatccctggttcagtttcagcaacttccaaagtaaccgtgtttggcaaatcgattcccaacacttcacccttataaagcgttacttgaacttccatgttttccttcaagaacttcaattcgtcttgaatgtggtcgccaggaatttcaatttgttcataagtttccgtattcatgaagacatagctgtcaccatcggcataaaggtattgcatcgtactcttttcaattggcgcttgttccatccgcgcaccggcacggaaagtcttgtcttgaacggctcctgtccgtaagttcttaagctttgaacgaacaaacgcgccacccttaccaggcttaacgtgctggaattccacgatgcgccaaattgcattgtctacttcaatcgtcaaaccatttttaaaatctgcagttgaaatcatttttaaaaatcctcctcaaatatatctttataactataacaagaccgagccgctgtggcaactgtcttaactataaaatcagtaaatcacgagttgcagtcgtcagtcgttcatggccctcagcagtcactaagacatcatcttcgatccgcattccgcctaaatctgggaaatataccccgggttcaacagtaatcacactgtttgcaactaaggtgccagtcgtgttttttgagatcaacgggccttcatgaatggcaagaccaatgccgtgacccataccatgattgaaggcgtcaccatagcccgcttttgtcagcaaatcgcggccaactgcatccagttgagcagtggctgctcctgcttggacctgatcgatcacagcctgttgagcggcctgcaccgcctggtaggccgtaaccaacttatcatccggagtacctaaagcaaacgtccgtgtcatatctgacgtgtacccgtccaaaaagtaaccaaaatcaagagtaacaagttgcccggccgtcaagagtgctttagaagccgtcccatgtggcaaagccgctcgtgcaccaccaagtacgattgtcgtgaacgacggcccacttgcaccgtgcgtccgcataaacgcgtctaacaggttgctaacgtcgatttcacgcatgcctggtcgcacgatactcgttacgtattcgaaaccagcatccgccaaacgtgcactcgctcgtagccggtcaatctcatcaacactcttggtgatgcgcaactcatcgaccacgtctggtaacgcaaccaaatcgctgaccaagttctcatctaagtaactgtaggctgtatatggaatctcggcctcgaagcccatgaccccagtaccggttttggcaataatatcacaaacggcccccagataatcacgtgtaatgactaggtgctggtcatcatactgaccggcaaaagctgtctgataacgggcatccgtaatcagataggcttcctgtgccagtactagcagataaccatcgccagccatatcagccattcctgttaaatattgaagattagctccatctgaaactaagaacgcatcaatttttaactgatcaaacttattttgtaaccgttcaactcgactcattatttcgtcactcccatcattacctcacgcttcattataccaaactttccaaaaactgaaggtaatgatttattgaaggccattcgtcaatcaattacgtttacggctaagcggcccgtgaaccaataatagtcgcgggtatccctagattgcttcacaaaaaaagagcctccctgcagaggctcttcaaaaattattttgctgggtaaacagatacttggcgcttgtcgcgacctttgcgttcaaaacgaacgacaccgtcagccattgcaaataatgtatcgtcgccaccacggccaacgtttacacctgggtaaatatgggttccgcgttgacgataaagaatgttaccattcttaacagtttggccgtcagcccgcttagcgcctaaacgccgaccagctgaatcccgaccgttggcagttgaaccgccacctttatggtgagagaagaattgcaagttcattaacatagtaaagtccacctccgaatgtggttatcgtgtttgttcacgaactcggatgtaatctccgtaattcgtggccacatcgttcaaaccaagtgtgaaactttcaagtaaggtttgtaattgtgtgttcgccaagtccagcttagtgaaatctgcaattaatagcccaccattggtttcatcactttgtactacgggttgcaagcgggcaacttgttcaatcccattgattgtactaattgctaacaccgaaaccgctgcacaaacgatgtcttgtccataagcacctgaatcagcatgtcccgtcaacttaaaagcggtcacttgaccggtcgcattacgagaaatggttgcctgaatcataaagaatgcctactttcttaattatgcattaattgtgtcgatcgttaccttagtgtatggttggcgatgacccttcttagtatgttggcccttcttggccttgtacttgaaagtaaccactttacggtcacggccttgcttttcaacagtaccttcaaccgtcgcaccatcaacagtcggcgttccaaccttagttgtgtcaccaccaacaaagactacttgatcaaaagtaaccttgtcgccagcagcagcgtcaagtttttcaacgtaaattgcttggcctgcttcaactttatattgtttaccaccagttacaataattgcgtacacgtttgtgcacctccttaaattataaatcacttagactcgccgaatgtaagtgccattgctgaacttaagactcaatccgtgcggttgtagctgtagaagtccacaaatacaacaggaaaatattatcaaattttttcataatagtcaaggattgatttcacttcacaaaaaagtccgtgaaactaatgctccctaccgtcatcaaatggtgcatttttttaatacacttggttaagtaatgtggcgtgtagatcatatcattagctagccaatcagtaatcaggccgactgtcgcagaaacgtaatacgcgatttgaatgctgaccggtacttccaaatcagcaaattgatcctgaaaatcacggtgaaatttcgtcatccacgtcgtcatctgctgattgatccgttgattgaccgctaactggcgctgatctaacaatagcgtctcaaaggcttccgcgtgctgactgatgtaaccgagtgcctttgataaggaaaaaacatgcacccgctgtaacgggtcagccggattggtcataatatcacccactgaaaccgtcacgatggccgtttcaaacaattcacttaccaagtcatctagggcctgatcaacaaatgctggcttgtctttatagtggagataaaatgttccgcgggtaactgctgccgtactagtcagtttttgcacggaaatgttatcgactgtttctgtctgtaatagtgtaattaatgcttgtcgcaagcgccgccgagttttatcgacacgcggatcaacttcatgactcatatctgctccctactttcatttcataattaatataacattaattactaagagcgtctaacagatgataatcagccggacaaatagttagattacgtctaagatggttctcagtgatctatctggcccattcattcgactgacacatgattgatatggggctcacctacctgccactatcatactagctggttagtccttacatgccttagcatcaattcaaagctaaattgatctttagaaacgctgtaaaggattttatcttgacaaccgaccaaaataaccgttatactaataatgcaatttttgggaaaagtctggcttttcctgttaattcggttgcaatgtacactattcttgtttaatatagtcgttattggactaatcaaaggagggacatactcttatgactgttgttgcaaaaccatataacacatgggcatcacgtcggccagttgctgggaagcaaaagcgcattcgtcgcgaaaaagaagttgctgctatccaacgttgggctgccggcaagactgacaccatcgaaaaaacaccaaaaatcaagtaattaaaaaagaactgctcatcttgaatgagcagttcttttttaattgattgattgtataatgccaatgtgcaagataagaactcccgttgactaacggtcattacgggaagcagtgaaatgcttactgcttgcattttctttggcaacaaagtttgaataatattgaatgccaccagcgatggcgatgataccgacgattgcaaatactgaacccataagaattctccttccttgttacatgattattatcgttttgttacagtaacatttcaagcgaaataaactattttagtcagttttgttaatttctttatcttttcttaagtattttaggagatattggttcttcgccgtcgccatttaacaaccccgtcttgcaaaaattaaattaatgatgaccggacttagttaccgctattacagcgtttatattgtgtcgttcttcaagcattaattggtattcatgaaaacaatttcctcgttcaccaggctaacttcatttttgactttcaccataatgaccaattatctcagcaaaatgtgcttactgtaatttagtgccttttcattacaaatattacatttttacatcattctgcttactcacgccttttttaactgctgcacatcggtgaaaaattaaataaaaattgacactctccagcttcttaactataattaatcttgttgttgtcacggtagctcaactggatagagcatccgccttctaagcggagggttgtgagttcaagtctcactcgtgacataccatcgattcggacctgccattttaaaatagagaagcttgttaaaccaacatttagcaaacttctctatttttggtttctaataaatttcggcagccaaatcgtattcgtgcttattaaatcagccaattaacggcatagatattaaaaaggtcaacaactacctaaactgagcatccacataaaaaactatctgagggcgccgcttcgctctaccctcgtaatcatgatatgaaacaaccgccttctcagttataatgactgcgaaggcggtttcgtgttcatcgtgtgcttattggtgctcgctttagcccgtataaaaaaccgatggctttcagttcatgagattaatcaattgtcgtttcgtacacgtaaataaaatttcaaccctcaatgactgaaggtactgctttcaagattattaggaggtgagttttatggaagtcgttgctgaaagtgttgctggtattgatgtccatcaaaaacagattacagtttctatattggtgggcttggctaacgccaagcctaagaaaatctcgaaacgttttgaaaccattacttgtcggcttaaagattgcggtgaatggcttaagcaacgccatgttgaacaagttctaatggaaagtaccggtcagtattggcgaccggtttggcaaatcttggaacccttcggtttcaagatgatcctgtgtaacccgcgaattgttaaaaacattcctggtaaaaaaactgatcaaaaggattccgaatggctatccgaattggcgcgttacggcttagtttccgcaagttttgtcccgccaaagtcgattcaagcattacgcgaatcaactaggttacgtaagaagattacccaatctatgaccgcaaccaaaaatgaagtccataatcttttacaacgctcaaacattaaattaacgacctatatttccgatatttttaacggaactggccttaaactgctgaagttactcatagatggtgaagtcatcactttacaggccatcacaaaatgtcgccacacccgcataaaggctagtgttgaacaattatttgctgcgatggatggcattctgccacgcaacgatcggagattgttgggcttgaatatggaactactcgctgattttaggcgggtattggctgaactggatgctcaaattgatgaacaaattatggaatttaatgatttgtatcttcgcctacaagacattcctggtatcagtcaacggattgctcagataatcattgccgaagttgggtcagatgtaagtccatttccagatgctcatcatttagcttcttgggccggtctctgtccggggaattatgaatctgccggtatcaaacatggtgctcatatcttacatggcaatgtttatctcaaatcagccatggtaagcgcggcgcttgccgccaaacagtccaaggaaaccggtttaaaagactacttttggcgattgcacggtcgcatgaccgcgcaaaaagcgctagtcgcactggctcataaattattacgaattatctacgtcatgattgatgaaggcaccacttatgtagactataaaaaggaccaacgcaaggcaattacgttgatcccacaaacttaaatactagctagtagctttagtatactagtttttttcaacactttcgagtgctttagattagtgcgctcaaaaattattttgtttcaaataaaaacaaaagtattaggttcacagcttgtatgagtgaaagagcatttgccgcattggacaatatcaccctattacctaaaaattgcattctatccaattaatttggtggaagacaaactgaaaatatcaaaattgtaacagtcgtcgtttataataccaatttacaatcaagacaccgtccaatccaccacaaccttggtgtagtacaatcaacgtatctaatactgtctgggggaatcaacaatgcttttacgccatggcttaaccagtaacatttatctgaacgattacttaacgtttattcagcaagggcgtgacacctttgaatttcatcataacttattagtcgcacagcaccattaccacctagtcatcaacgcccaccatgcctttaacgctttctacgctgaacagaagcggctggccgagcagctgatggactaaatcaattctcgcatcccatcctaatagtgcgtataatatgttttgaggtgaaacatattgaaacttgaagcaattgccggaaatatcgcgcatgccatcaaagatcgttcaactgacgggccctacgtactcgcggtcgagtttacggacaaagccaccaagggaaagtcagccactggttgtgtcatcgtccggatgccagatcaccagcactatacgatcaccagcaatgactttcggtatatggatgcggacaaagatactttagctgaggaactcggggccttctttgaatgcaacgatgatcttgatcaacgacaaacattgatcgaccaagttaatgacttagttgcacaagacgccgataacgacgcgcaattaatgacagaggcttaaaaaaataacctagttacgtgatcaaatcgcgcaattaggttatttttttaatagttatttgcttgtcgttgctcattgacatgatttttggccgtaaacgccgtttgtatctcgtcctgagtaaaaccaaaatcaactagcccaatcttcaagaaaacgtgccaagcgtgctggtagctctcctgacgatggttaaagtaagcatcatagaggaggtgcttgatcgccaagtactgtttattcaaatcagtcgccggcttagccgcaatcgtagtcaattgctcaggcgttactggaatcaaatgcgtccactgttgaatcgctgagacaaggaagaagaagtccatcgcatctacgtattcgttcagcagcgtttcgcggtgtgtcttatcaggatccgctttgccacgatgaatcttccaaactttgaaccattccgacgtattagccatttctgccaattcgacgtccagtgagaccatcgcattttgcaaccgttcttgtggccgccaatgaatctgttgacgggccgtaatatcgcggtctaaacgaatcgactgttgtaataacgttgttagttctaacatctaatacccccgttacttaagcaaatactaatggatccgcttttatttctagcgaatcgatattttctaagtaccaatcacgcatgaacccaaagtgtaacaacacgtcaaaccacgaaactgcttgatcaggatcatgaacagtcaggacccattgttgactaccgccagcttcagctgcatcaaagatatcaactgtcaaaccagcccgcagttcaatttgggcaccatgtccttgctgtgaattacgcaacatgtgctcattcttagccgcactgacaaacaatttgtcaacgattgcccgatctaaattagccgaccgcagttcatatttagccgcgttagcaacgtccaaaatattaaagtcgacgttaaagccaaaatcatcttgtaagcaatgtccaaatttaattagcgttgcgagaaccgtattaatttggtcaaccccagtccccttcaacaataatttattaataaataaattcgtaaacgccgaactattaaaccgtaacaagcgccgttctaaatgaatataaaacaagttttcgccagttgtttgttcacgataatatgcaccaccgttgccgttgttcaccacttgatacaagaaggtgtaatcatccgttagcgccccgtaaacgtgatacagcgcttcagtatgccgttgagaattcagcaccgcttgttcatcaccatgcatgcccaataaccgactcatgaagatcaaataataatcggcattctgatattgatggggaaacgtcacgtaagccgtatccagtttaaagtctgctagctgttgtgccgctgctaacagtgtctctccgtcagttgtatcaatcagttggtccatcaaggccgtaaatttttcaccattagcgagtcctttttttaagccctcattgaacgtactcagcttaccgtgagtgctcagtgttgccgtgtccatctgcttgtccgtattattcgccatcagccgctacctgcgccttcccaatcagcgtggtcaagtagtcaacataaagactacggttacgctcattaaaattctcaaaactcttaaaggcgttttcaatcgcttgtttctcataagctaaaatcgtatcttccttagaaagcgttaaaatcttagcttcgttatccttcatggttgcatgggcattattagcttgttcgtcttcatcggccaacttagttaactggtcaataatttgctgccgttcttctttgatccgaccagaatcaaatagtgagttacgttgcccattttcctttagttgctgccgcaattcttctttttgcgcatcacggtctgattgcgcgtcaatcagtttctgtagctgatcgctaccagctgagatctgctgaatacgatctgtattgaaacgtttgtgcgcgggagccagttcaaacgtcttttgtaatttattgtattcttccgaactaaattcaaaggcgactttcaaaacgttcaatttaccaaaccggcgccgatcccaccagttaccaaagtaaatctgaaattcgccgagttgggtttcttcataataaaagaatgggtactcatgagccaaataatcaattaacttggtactcaagtagtgactgattgccggatagacatccgtaattaaatccacttgggcgttacgggttggatccggttcctcgttaagtaaggcttggtgatagtggtcaccatcgatcaattcgtagatcaaccggtcgtcaccagccgtaattgcttggcgcaccgtagttacatagtctaacttttgttgaagtcgcttcgtaagcgcgcgcgtaggttgatcttgtttttcaagatcaggctgattttgtttttccataataatctccttgcaatcaataataattgaaaacttgctgaattgcattgctgttcctaatgttaccgaaaattagtgcattaataaaggttaacaccactaatttaccaattttataacaaaaacggctagttcgccatttaaggtgccctaaccgtcgtatttttatctcaattaatggtttagtacaattccatgtactgatcacgttcccattcactaacttgttgacggtatgaagcccattcaagccgtttagcttccaagaaactctgataaatatgtggccctaacgccttcttcatcgtcggatctgtctggaactctttcagcgcattgtgtaacgttgatggtaagtcagcgataccagctgcagcccgttcatcttcatccataacatagatattacgatcaacactctttggtggttcaataccgttcttgattccgtccaagccagcttcaagaaccgctgcaaaggccaaatatgggttagttgaagcgtccacactccgtaattcaaggcgcgttgacaagccccgtgcacttggaatccgaatcattggtgaccggttagatgctgaccaggccacgtaaacgggcgcttcatatccaggaaccaagcgtttgtatgagttgactgtcgggttagtgacagcagtgtatgaccgggcatgcttcatcaagccacctaagaagtgataagcgtctgatgataattctaagccattcttatcattagcatcataaaaggcattgccttgatcatggaacaaggacatgttcacatgcatcccagaaccattgacaccgtttaacggcttaggcataaaggttgcccacaaattgtatttccgtgcgatggtcttaacgaccaatttgaacgtttggatatgatcggctgcagataaagcatccgcgtacttaaagtcaatttcatgttgaccaggtgcaacttcatgatgactggcttcaacgttaaaaccaagtcgttcaagttcaagtgcaatgtcccggcggcaattttcacccaagtccattggtgataagtcgaagtaacttcccttatcattcaattcggtcgttggttcacccttttcattcatcttgaataagaagaattcaggctcagtcccacagttaaatgacgtataacctgcttcgcgcatatcgttcaagacacgaattaagttgttccgtggatccccttcgaacggcttacggtcagacgtgtaaacttcacagataatccgtgcaattttaccatgttccgtgttccaaggcatgatcaaccaagttgataagtcaggatacaggtacatgtcactttcttcgatccgaacaaacccatcgatggatgaaccgtcaaacatcaacttgttatccaagagtttgtcgagttgtgaaactggaacttcaacgttcttaattgtgccgaatagatcagtaaacattaaccgtaaaaaattaacgttttcttctttgacgatgcggcggatatcgtcttttgagtaggactgttttgccatgaaaatcgctccttaaattgattgactaacgaatgcaaacatcttagtgtgccggataattggggcccttgtcggactgcaagcctccgagattcaggaattcatcatgaaggattcggcgcacatcgcgatcagttagcggcttagccaagtcagcttgcttctgctcagctcgctgtttttggagcgcatatatttctttgattccagccatattgatgccatctgctaagtaatccttgatttcaagcaaacgatcaacatcattcaacgaaaacattcgccgattaccggcatttcgttccggcgtaatcaattcttgctcttcatagtagcgaatttgtcgcgcagacaaattggtcagcttcataaccgtaccaattggcaagacggccaacgagcgacggagttccttttccttcataacgaccctcctctttaatacagacttaatattagcaatgttatcatcgaatgtcaatcattcatgttagaaaatatcacacgttttatcataggtataccaatttataatttagcttaaccaactagctagccgttggtcaatcgaggcccgtaattcagggtgttccaatagattgatccagtcgaccgacatcttgttacggaaccaagtcaactgacgcttcgcataacgacgtgagtcttgtttgatcttagcaattgattcgtcacgcgtctgctccccattaaagtaagggaaccattcgtgatacccgatccccttaccagccggtaacatggcgccaccttggtcaaatagccaccgcgcctcttgttccaatccggccgctaccatttgatcgacacgttgattgatccgagtatacagcagcgctcgctccgcggtcagacataaggtataagcatccagtgtgtcaccgtgcatatccgcctgctcagaaaaaagctgaccagttgtatgcacgtactccaacgcccgtacgacccgtaccaagttagcgggcgcaattgcggtggccgcctgcggatcacgctgtttcaacgccatccacgccacatccgaaccttcgacagcggcacgatcaaaccaagcttgacgatacgccatatcaggttcattatccgctggtccaaactgatagcccgccaacaaggactgcaagtaaaagccagtgccacccacaataataggcagtttaccccgagcactaatatcaatgatcaacgccgtcgtccgactgacaaattcagcgactgtaaaacgctgatcaatatttttgatatcgattagatggtgggaaatgcccgcctgctcttccggcattattttagccgtaccaatatccaagtgacgatagacctgcattgagtctcctgaaatgatttcaccattcagctgtttagccagcgctagcgataatgccgtcttaccgactgctgttggtcccgcgattagtaatactttatgtttagttactgttgtcactcgtttaacctccttgtacctgcttacgaattcttcgtgctaatccagggtagtcggtaatcagtcccgcaaaccgatgacgataacagaaccgcatatcgcgttccgtgttgaccgtccatggccgcaactgcacttttggcaataagagccagtgaactcgcacccaacgaatatccggatgataaccgagaacaatgtgttgcgcatgaagccgcttcgcagtttgaaccttagtcttgaacaggctatccgattcgacctcgggctgtaaaatatgcaaccgttcgatcgactttccgtagaagctcgaataaattagcgtaaacggaacttgatgatggttaaaataatccgctaccaagtcttcgatcccctcataatgaatcttattagttttgatttccagattaaaaataccagtaaagttgtattgaatcaataattgaaccacttcatctaaagtcggaatacgcgttcccgcataggctgatgcatacttaacaccagcgtccaattgctttaactcgaccaacgtgtgatccacaatccgacccgttccgttagtcgtgcggtcgacgagctcatcatgcataataatcagttgcccgtctcgcgacaagtgtacgtcagtctcaatgccatccgcaccatcctcgatagccgcaataaacgctggtaacgtattttccggcctggtccccttgctaccacgatgagcaataatttgagtaagcattgcgtttcaccccacttttttaaaaattagattgaattgattgctatctccgcataaaacaagcataataaaactaacaattgctaggaggttttactaatgaaatcatttacccgtggcttcttgtttggggtcgtcgcaactgctggtgccgtaattggctccgtcttatcatttaagaagcaagttgttgatccaattgaagaccaagaaaacaaattcgaagaaaaccggaaaaaggcgatgcgcaagagtcgctcagctcacaacggttaattaaataaaaaatggtggccgaacaagttgttgttctagccgccattttttaatacttcgcttttttcgtcttaccttcccaacgtgcgtaaccgggttttaaaatgtatagctgtgaataaccattcttagctaatgtgacgacggcccgtgtacttaacgtatgggtttgatcgtaaacgtagattggcatatccttgcgaagttcgttcatccgaactttcaaactgttgaacggaatattccgagcccccagaatatgaccagcgtcaaactctttcttttcacgcaaatcaatcacttgtgccttacgcattcccgcctgaaacgcttcttcgtccaacatcgtggacacctgacgccgtcgaatgtaactatacaactcataaataaagtaggccgcgattatgataactaacacgatgttaacatacgccatgccgctcaatgcacctaaaaccacgttatccctcctaatttctacttatctattttacacaaaaccgcttacttttactaggggtaagcaggaaaagccgcgattaaactgctgactaatcctgaattcccaccgattgctttatggccgtactcacccacggtttaaaggcatccattaaaacggtcgggggcctgagacccgcatctaaccacgctgttaattcaaaaccaagcatcgcggtatcacatttatgaatccgaatcgatcatctgaatctgactaccatgcaccagtaatccccgattgttagtcaaccgtttgaccgtaacgcccgtcttatgttcccagtcagtgatccactgcggcaattgcggctttacttcacaatgaacatcataatgcggataaatacggatcgtcgtcgtattgatggctgttgtgcttgccagttgctcggtgtggtcctccgggtataaataggcgtacaggtctaaatccgggcctaacaagatagccccagcgctaataccgtagattggcttgcccgccagcgcgagagtcctcagtcgttccagcacgtgcgtttcacgcagattcttcaacagtaaaaactcgtagccaccattcaaaataatgaccgttgccgtattcaatgcggccaaatcatccgtcaatacatctaggagctgcacgtgcgcatatccaagctgctgaaccgtttgttgtagtgccaccatttgggggtgatttttacccgtgctgaccgaattgacaataatcacaattctcgcactgttcttagccaccggcgccactaaagtgaaaaaggcgtccgttacggccacagtgctaaacgcccgtgaagacaataataactttaccatcctgcttctccaatcaattctgtcatctaattcaattcacgctagtcgatccatatcccttgtgccaaatcgcgtaacagttcatacgccgttacaacagcataccgacatgaaactaaaatcgcgcatagtctgaggacatgagcccaaatcagcatcggcaattggcgctcagtttttaaccacaacctaatcagcacagtttttggagcttagtataaaaaagaagctcggacattacttccaagcttcttgacgattgattttaacttaaataaaccgttgggccaatgaacctgctccgataacaccagcgtcgttacctaagaccgctaacttcaaagcagtcgtgtcgcgaatcgttgggaatgtgaattggttaaagtaactgatgacttgacctaataagaaatcaccagcagctgaaaccccaccaccgataatgattgaagatgggttcatcgtgttcccgacattagctaatgccaagcctaagtaataagaaacccgatcaacaacgcgtttagccaagacatcgccttctttagctaaatcgaaagtgatctttgaactaatttcttcaccgttgtctaataattgtttcaacttagaagcaccagagaattcttctgccatatcgcgagcaacgtgaacgacaccagttgcagaagcgtattgttccaaacaacctttcttaccacaagtacacatgtagccgtttggttcaaccgttacgtgaccaatttcaccggcaccaccggcaataccatggagtaaacggccatcggcgatgatcccaccaccaacaccagttccaagcgttacaaagacaacgtcactaccgttttcgccagcgcccttccaacgttcgccaagtgcagcaacgttagcgtcgttatccagcgtaaatttgatgccagttcccttttcgatttgagccttaactggttgtaaggtcttccagtttaagttgtaggcaccgataaccgtaccattatccaaatcaacggtcccgggagtccccattccaattccgataaattgagaacggtccatcttatataactcaatgtggtggttgatggaatcgatgatgttaggcacaatgtgggccccttcatctaaaatcgtggtttcaatactccacttttgttgaatatcaccattttctgttaaaatggcaaacttagttgtcgtcccaccaaggtcgactccgattaacttacgctccatgttgctaaatccctccattagtcatgcgccgcgtcttcacgggcgcgttctgcttctatccggtgctcatggctcaatacgagcttgacgcgggcatacatcttcgggtcaatgacaccagcttgatagagatgatcgatctcaatggccattaactcaatgtcccaaattcgcttgcctacgtacacgtacacgccaaattttttaagtaattgttggacgtcgtaaagtgttttcatgtgcatatcctcgattaattatacagttaaattagcatttgtaaaacccatttttagtaaagctaaccagccaatgactagaataaccgttgccacaattcgtttcagcggcgcaatcttgccaattcgtggtacacccagcagatagcctaacaaaaagccaccaactagacccccgacgtgtccccagatatcaatgccattcgagaacatatcgaatactaaattcaaaacggttagtagtaaaaattggttcgtgagctggcgaatcactggattttcccagaacgattccccaatcgtcaaaaaggcaccaaagagtgcgaaacacgccgtactggcccctactgactgattattggataacgcgaaactcataatattaccactaatgccacccaaaatataaattgccaacatccgccaatgaccatacattgcttcaatttgcatgcccataaaataaataacgacaccattcagtgcaatatgagtaagtcccatatgtaaaaacatcggcgtcaccaatcgccaccactggccggccgcaattgcttgattgttcttagcacctagtgaattaaaaatcagcatggcgccgtcgcccatcagccactcgactaagaagactgccacagtaattccaagtagcacctgcgtgatagccggttcagtttgccaccagcgtttaattctcatcatgttgttcatcccctgctaccaagagttcgtctaacaagacgtcatattgatcaaccggccattcagcgtgttcaaaagccatctcgtcataagccagtgtcaacttcttacccggataatcagcgaggtaacgatcgtagtagccaccaccaaatccaatccgggcgtgccggtcacggctgtacccaagaccaggaactaagatcagatcgatctgttgcttggcgactggttcacccgtgacgggctctggaattccaaaagtcgttcgctcaagtcgatcagtcgcttggtaaggataaaaagccatttgacgatgcggcagcgtttttggaataaccaccattttgccctccgcccaagcttgttcaataagtgggcgcgtcgctacttcgatgtcactactaattgtcatggcaatgacctgggcagtttgccatgttgggcttgcaaataattgggtctgtaacgcctggttttgccgttgccggtcagccggcgtcatttggcttaatcgcccaagctgttgcttacgaaatgcttttttctccacgtacggcacccccgaaaataaaattggtataaaaaaatctcattcattaacatgtcaaattgaaaaatcaatttggcagttgccaacaaatgagaaacccattgtctgatgacaatgttacagaaaaaacaacaggagtccccgttgttattttgtttcacgatgtaatgtcactttgtgttcccgtggacaatacttcttaaattcaacccggtccggattgttccggcggttctttgaagataagtagttgcgttcatggcattctgtacattcaagtgtaatgtgtacccgcatgttgttgaccctccaaactcattcgcatattacagggccggaacccttaacttgaactactataccattaatgattaaaaaataccagtatcaattaagatactggcacgaaaaaagctgattttttacttgttataatacttccaaaaggccttataaatctgtgtggcagttgtcgtgttataagcaccgttggttgcagtaatcccaggaaaggcaatggcaatcactaccttaggattcttataaggtgcataagtgactaaactcagtgtttcggtagaagtggtgccatggaaagtttcagcagtcccagactttgcggcaacggctggtgaaagattctccagtgcgctcccagtcttataggtacttgtcccatggaccacatcccaatacccttggtgtacgacatcaaagtatgaggatgggacgtcaatggtattcaggacacgtggcttaacattagtcttaacagccccttgagacccgttagatttagtcccagtaatggcggaaacgatgtgtggtgcaatgcgttgcccaccgtttgccattgtcgcaatgtattgcgccagctgaatagtcgtgtaagcatcgtagttcccgtaggacaagtctaacgctttaccaatatccttctgtgccgaagaaccttggtaacctgaggcttcacccggcaagtcgatcccggtcttaacacctaagccaaactcgttaaaataaccacgaagtttagagaagaccgaattagacatcgtcaaggctttcccagacgcatagctgaagttaccttccttcatggctaattgcatcatataggagttagaagaaacttccatggcagtcgaagcgttaagactcagactagttccaccattcttgttaaaccatgacgacttggtggccgttccggctaacttgatcggcgtatcggtcaaagtactattcgtgggtgtaatcacaccatcttgcaaggcacccatgaccgtagcacccttaacgaccgaccccataacgaaggattggttgatggttcccaacgcattttcagtcactttaccagtggatagattccggctggcacctgctaacgcataaatggcaccagtgctagggttcattacaacagcataggctcctggcgagtaggcattactactccccaccgttttggcttcagacataatgatactttgaacctttttctggaacttcgaattaatcgtcagctgaacgttgtcacccttctggccaccgtacttcttaatctccttttgaatgaccccatcctgcgtcttgacctcagtctgtgacttggttccacgaaggacattttcgtactgcttttccaattggctttgaccaaccgaatcatcacgagaatagccttctgccagcaaggttttaatgctatcactcggtaacccttgcttttcggtcgtaactgtcccgagcacactactcaagtcagtcccattaggataactccgagtccaactcgttccgaccttaactcctggcatttcggattggtgctcaccgatttcagcaagctccgtactcgtcacaccagtcgatttgatattgaccgttgacagcgagtacgccgaactcatcttataataaatcgccgccgcattcttttgcgtagacgttaaattatcaatgatatgtttttccgcataggcgacttcccgtgcgtacaaaacatcatcgtcgctagacgttttaaccttcttagcaaccgactttaaattagccgcccccgctaagtaataatcagccaagttccgatccgttaatgtatccgttggaatggttaagtactcacctaacttattcgccacttcgtacatcttagtcgacgcaactgacagccccttcgtgtattgaatcgcttggtgggatttgtttcccactaagacccgaccggttgaatcataaatcgatccccgttgaacgtttcccgttgccgtcgtattattggctgaattcactgtacttcggaacttctgtccgtagtcaacttgtaagtaagctaactgcgcaatcaacgcagcaaataacaagaagacgatgaaaaacaagaagttcagccgaaatggaatatgcgacttgttgggatcacgatttatcgtaattttcttaaacaatttcaattctcaggcgctcccattcttaatttggtaaacatttcgcaaaaatttaccagatgatactagcaatcctagataaataccatacttatgttattctaaacgatagacataaaaatttcagccgttattacggattttaatgtttttttgattatttttctgtttggctgtgaattattagagattgaggtggcaatttttgaaactccgtcgtttttttgacaagcgcacatggccattatggatcagcttttggttacctttactgatcatgaccggttattttatttatcggcacatggctccctttggatcaagcagtctgttaacggtcgatttaggccaacaatacgttgacttgttttcctatttccggcataccctactgcacgatccgagtgctttcttctattccttctccaaaacgattggtggcgagatggttggggtctgggcttattacttaatgagtccctttaatttaatctacttactattccctggtcaatcaatcactaccggcatttttatcgtcactgtactaaagtatggtttcgcagggctatccttcgcctggctactaactaaaacgcagacgcaaaagggttggttggtgccaactttcagtaccgcatacgcattgatgggctggatggtcgccaatcagctcaacatgatttggttagacacggtcgccattttaccattggtcattttgggactggaacgcttgtttacaactggtaaagtccgttacttcgctggctggctggccgtcatgctaattgacaactattatatgggctacatggtcattttattcagttgtttatactggttgtatggcgcaactaagtattggcaaaacgtgaagaccttagcaactcacgccctcaaatttgcttggggtggtctgctaggtgtcgcgttctccgcatggttgctattaccaactttctgggcactcattcaaagtaaggctcaatataatgtgaccaaggttcattggaaacttgaatacgcgccctggaagatgttagctaagttcgtcaccggtactttcaacttcgatcagatgccatccggtcaaccaaacttttacgtggcatggttagcagttctcgcctttgtgctcttcttcttacggcgccagttcaaatggtccgtgaagttgagcgccttgattgtaaccgcgacgcttatcttatcattttgttacgaaccacttgatttattgtggcatgcgggccaatttccagtttggtacccttaccgcttctcctttgtcttttgtttctgggtcgtctggattggtgcccaagcactgacagacaaaataacgatcaaactgtggcaagcgctaacgatgctcgcattgctggtcggtttgtttacaaccatttacttgaacattaagaaagtcacctacgtcacccaagctaatctcttaattacaattggcttggcagcaattacattgattttcttaacgttgcctaaggaacgacgtctcatttatcaaatcgtcgcgttaattttagttgcgactgatatgtcgatcaacgtggtcgcttcattaaataatatttcctacgtgtcacaaagtgagtttggtaaatacacgcaagtccttgacaatgccgtcaacaaaattaaagctagcaacgatcgtttttatcgaattggtaagacgtttacacgaactaaagacgatccgatgcaggcggcctataacggtgctgatcatttcagttcgaccttcgaaagtattatccctaactttttcggttcaattggtcagccggatggggacggtgtggtcgcctacaccaacgggaccatgattaccgattcgttactggacatgcagtactttatggataaaacagtaccgacatcccagactgataacgcgaactatcgtagctacattccggtcaccagtaccaagaaagatctgacgaattaccaaagatcggcaaagctcagcactaacaaagtcacgacctacaaaaatccatacgccctgggtattggtttcgcagcgtctgacaagattactagcttgaaagtctccaaaacaactggcgatccgattgcccggcaagagttgatttaccaaaccttggcaaatcgttcaaccagcggcttgatcagtgccgaaaactttaacgaagtggtcttccaaaacgttaagaaggtcacgacgttaactggcgccgtcttgaacaaacaaaatttagcgaaaacgggatcggtttactttaagttcacgccgacaaccaatgattcctactacatcacgctcgggcaaaacctaactacttcgaatgcgagttactacattaacggtaaggaactcaagcagtacccaacttaccggcacacgatcgctgttaacgttgcatcgaatagcaagggcaagaccgtgacattcgggattcagatgaagaagacttctctctggttacaaaacttcaccctctacaagttggataatacccaattcaagaagtcggcgcagaaactccagcaatccccttggaacatcacggcccactcaagtcgtaagattactggtacaatcaacatcaagcatcgtcaccaagttttgatgacgaccattccttactccaagggttggcatgccactgttgatggaaaatccgtcgcaactaagaaagtgattaatacctttgttgctgtcccattaagtaagggcaagcatacggtcaccttgacgtatcgaccgccattcttaatcactggtagtctgattactgggattagtgcactcgcaacggctggttggtttatcgtccggcgtcgacgccaccacgcctagcccagttcacagtcaaagatgtggtcagtaaaaatcagcgttacctgaattgttaattcaggcaacgctgattttttgtccaaatattaatcgctattggcaagcactcaccagaactactcgttattgggcgtgtagtcatacttcgggccgtcattttgttcatcataatcaactgtgagatcatagcccttaaagaaccattcatcacggtcgttgacatagtaattgacaccatccttttcaaccatggcaatcggttgatggggttcgtcatcacgcatgatcccgattgagaagccactgtgaactgctgtcttgccataagttttgccgtaaaagcgcaccccattaccagtggttacacccatgtcatcatgaaaccacttactggccaaatctgtaattgttattttcattactaacacctcatcattgaaatcgtttacagtaattgtgccctttttgcccataaaacgcaacattgacagtcgatgagcaagccaatgaccagttgcgttcctgaaatgaccgctaagggagtctttatttacagcgtcattgttttgtggtgtacttaaactacttaaggaggtgaaacccatgcaagtgaacattgaaacggagcccgacacctcaattccaaccgtcacactgcatgttccagtcgactaccccgaaacggccgccctcactgctgctctcaaaaatctttcaattgaggccgctacgttaaccgtttcacaacgtggtcaactcgtacagttaccgcttacttcgatcctattcatcgaagcaactggtcaccaggtcgccgcccatacgctggataatgtttatcgtgttcccaagtcgctgaccgctgtgggcacaggcttacctgcttactttcttcgcgtctccaaatctgccattgtcaataccaaacaagtctattccttgaccaagacattgaccgggaacttgattgcgtttcaccactcacctaaacaactgtacgcttcaagacgctactatcgccaactcaaaataagtcttgaacagaaaggactgttataaatgcataaaaattggttttggcccgtcttcttaattgccagcgccgttgttcttatcgttagtcaactcggtctcttcacgctccacgtcagcatctggagtctcttgttaacattgattctagttgcggctttaattagtagccttcgttacttgaatatgccgggcgtcgtcttcgctatcgcattcttagccatgatctatgcgcaaccacttggaatcactaagctcgtaccatggacaattttaggggctgccgtattactcagcattggtttgggtcttttgattcatccccgttatcaatatcattatcgctatcacaaccatgatcatgctcattacaatcatcataaccacgatgacgtccatgaatcaacgagcacaatcaacgatgaccatgttaatttagatctctcactaggcaacagtatccgctacgttcacagcgaaaattttcgttctgcggatctgaacgtatcaatggctggtgccaaaatctacttcgatgacgctgacatcaaagaaggccgagcaaccatcaatgtcgacgtttcattaggtagccttgagttatacctccctcaaacttggcagctacaggaaaatctcagcaactcaatgggccacatctcatcgacaggtacaccgaccactgctggcccgggtgtcatactaaccggcagcgtctcgcttggtgaattacgaattatctatatctaaccctactttgctgtcggccatatcctgatcaatctgtcataaatcatgattaaaacatgccagttggttggattactgttcatcagcacttgcgcgtcctattccgacctccggggctgggtgccaattgctggaacgcagccgacgtcgatttgagctaacgcataacccgcgtcatctcaaatacgagtcttattctaagccggaagcaacccacttccagctaagaataatttggctactgagcattgtcacccagcccctccggtctcaagcctgtgaggggtcacgggttgaagccgagcattgcctagccatcggattaatgcggttttggcattagtccgttggcgtagcacgcacaggcttcagtggtaccgagcacatttcggaaacccgctcgaatggctgataaacggccacttaacttggtgcaattggtcgtcgactattttaatactggaaccttaagtacaatatcactctcagtctgacagttgattgacaaaattaccgtttttgaaaagcaatggccaatttatcaaaagttgggtacctcaccgtctgccattcgaatactatcccgactggaaggcgtttctgacaatgcccagtggtgaaatttcacttagcaagcgtcctttgcttggttagtgaaaggccagtatttgagacgtggtgtttcggctcaaatctgtgcccaccacgttccggcaattggcagaaatgcctggaggtcggcgtaggacgaacccacaacaaaagtctacgcgagttcgagctgtttccagcgggtctaagctggctgttttcgaacctacacaaccggcatgttttaatcatagtaaatgctaaaaaaatgtaacacgtccaatttactcacccgtttacctgctttgtgcagataagcgggtgttttgcttgaattccgaactcacacgcaaacgtgcttgttcagtaacgttcgttaaatagtggctggtaatcagtaatcgcgcttctaaaccaccaaaaaagactgtttcaaggtatccgctacctcaaaacagtcttaagcataaaattacgcgttttcaaccttcaaaattttaaccgtcatggtaccggctggaatgttgatggcaacttcttcatcaacgtgatgcccaatcaagcccttggcgatcggggaatcattagaaatcttgccaaccattggatcagcttcggcagcaccaacaatggtgtagctttctggttcttcatcaggtaattctttgaacgtcacgattttaccaacggagacttccgtttcgtcaatcttgtcactatcgatgatttcagcatattgaagcatgtgttcaaccgtcttaatccggttttctagcaagctttgttcattctttgctgattcatactcagagttttctgataaatcaccgtagctacgtgcgatcttaatacgattaataatttctggacgttgattaattcgaaggtcttcaagctctttttccagcttgaccttgccttcttctgtcattggatatgtcttatcttcagccaatgttttcactcctcaaatacgcaatatagttatcaaaaaccagcctaccatttcagattttaaaagtaaactcttaaatctaaaatagcgctggttaagacgttattttttataaaattgaacgaactttagttgtcaataaatcaatggcaacttcattttcgccaccttctggcacaattagatcggcataacgtttcgttggttccacaaactgatgatacattggtttgaccgtcgccaaatattgaccaatcacagagtctagtgtccggccccgctctttgatatcacgctgaatgcgccgaatgattcgaatatcatcgtcggtatcgacgaacaccttaatatccatcaggtcgcgtaaacgctgatcatctaggatcaataccccttcgacaatgatcacatcacgcggttcttgatgaatggtcttgtcgctacgcgtatactgctcgtaatcatagaccggcttttcaattggttgataggccagcaactgcttgatttgcttaatcatcaaatctgtatcgaaagccagtgggtggtcgtaattaacggcatggcgctcagccattgtcatttcactttgatcattgtaataggaatcctgttgtaagatcaacaatgattgaccagataattggttgtaaattgcattgctgaccgtagttttaccactaccggaaccaccagttaccccgatgactactggtcggcgatgtttattttcagtcatttaagttacgcctcattcttatttttcagcggcttcgttgtgcttcgaaaccttcttgatgtttgccgcgtgacccgcagcatcctttgcataatagacatcaccagtcttcaaatctgctacgaaatacatgtaacccttgctccgttgtgcaggatctaagactgccttgatcgatgttaaactaggactgttgaacggtccgggaccgtaacctaagttcaaccgtaagttatacggtgaatcagtctgcaaatctttattcgttaacgttgacttgttagaattgatcgcatagaacactgaaatatcagaatccaagcgccacttagcatctaaccgattcaagaagacgccagcaatcaaccgccgatctttcgtcgtactgccttcacgttcaactaaggacgctaaggtcattacttcttgcacggacatcttcgacttcttaatttgcgcgtagtatggttcaagctcatcattagtcttcgaaaccatctgcgttactaattgtttcaaagttgttttcttaccaacaacataagttgccgggaacaaatagccttctaaacgatagcgaacttgcttagcactcatcgctgaattcaacaattgtggatacttcttggccaatgatttgatgaatgtttgatccttcattaaggctagaaattctgccgacgtgaaatcagtttgtttttgaaccgtcttcgcaatcgtcttaatctgactaccttcaacgattaggactttaccactagaactctgaaccggttccgatgaaccacctttattcaaggccttcgcaatttgagcaagtgacatcgaaggcttcaactgatagtagcccgcgtgaaagtttgataagttgtgtgctttcgtccagtattcaaagacaaaaccactcttgatcaccttttcgcgctgtaaaatatcggcaattttcttaccattagcaccgtacgggatatcaacttgaacgacgcgattgtcgctactgtcatatggttgcgtcgcattatcaaaatatcgataacccaatacccccacaataattaaaagtacgactaaaataccaacaacgccaccaataacgtgtttcgaaaatgatttccgctgtttttgttctgaacgattaggttcatttaccccacgatcttgtgaatcgttttgatccttctgatcttggttatcctggttgttattcaagactcgcccctccatttattgattaatcttatcaattatacaaaactgttgcccagtttgcactagttcgccattagttttatggttttttaggatcttggacacacattaaacgccgaatgacttcaaatcattcggcgtttaacaagactatcaacaaactaacgaatttcagcacctaattcatccgttaaggctgtcagtactttttcaaatgctgtcgtaacatcatcatcgactaacgttgcgttttggtcttgatacgttaacgtataagctagcgactttttacccgctggcacgtgactcccattataaacatcaaacagttgaacgtgccgtaaatgcgcgccgcccttcttgttgatcaaggcaaccacggttgcgttggtcacatcgtcatcaatcaacatcgccacgtcccgggtgatacttgggaacttggagattggttgatactgttgacgcgcttttggtaaggcaatcaacgccgttaaatccagttcaaagacataagtttcccgaatcttgtaggctttggcagtcgttggatgaacttcaccgacgaaaccgactaactggtcaccaacgtaaatatcagctgtccgaccaggatgcatctctggatgttcggccgtggcaacgtaactaacggcatcttgcaacgccagactcttcagataaccagccacgatacccttaatctggaagaaatcaacgggttgttcggcaacgccccagctcttgggaaccatggaacccgtaatagctccggcaatgtgttcaatttccttcggccggacttgttcaggttgactgtaaaagacccgtccttcttcatacaatgccacattgtgttccttacgagcattgttataagctaaatcatccagcaaaccagaaactagactcaagcgtagcgtggtccgttctgaactcattggaaagtctaatttagtgacgtcactagcatgaagcgcaaaggccttcgacttagtctccgtggtcaatgagtaactgatggcttgcgtgaggccagcactttccattaacttacgtgagtcacgaatcacctgttgggtctcattaagcttaccgattgttggttggcccgttggtagggtcgctggtaagttatcataaccgtatagccgggcgatttcttcgataaggtcagccggaatatggatatcccaacgccgtgatggcaccgtaaccgtgaacgtttcattagcaacgaccgttggaaagtccaatcgtttaaaaatatcactgaccgtgtccaatgacaactcagttcctaagacgtggttgatccgtgctaagtcaatggttactgtcgttggttgcacatcctcatcacgaccgatgaccataccactagcaacttgaccatcaccaagttctgcaatcatggctgcggcagcgtctaaggccgttgcggtcatgccgtggtcaatgccccgttcgtagcgcattgaagcttcgctgtgtaagtcatgattatgggcagttttacgaatcttaactgcatcaaaaaccgcaccttccaacgcaatggtcgtagtctgatcagtgacttcggtcgctaggccacccatcgtcccagccaaacaaattggttgatcgccactacaaatcaacagatcactcgttagtaattcgcgatcttcaccatctaacgtcgttaaatgctcgccagctttcgccaaccggacgttaatttgaccgtcattcaattgatcaaagtcaaaagcatgtagcggttgtccatattgcatcaaaatgtagttcgttgcgtcaacgacgttattgattggccgcataccagcattccaaattcgaatttggagccataacggacttggcttaatcgtaacgtttttaattagacgcattttgtacattgggacatcatgttcgtcggcagcgacagccacatgtagatcatccgcagccaccgtcgtagcatcttcatgcaaatcaactttcggcatcgttggttgttggtcgtaaatggcagcaagttcatgcgccgtaccattcatactaagcatgtcaccacggttaggggtaacggacatgtcaataatttcatcatccatccctaggtatgaaaagaccggatcacctggcgtggcatcgtcaggcagaatgaaaataccatccgcaacttcttttggaactaacttttcatcaaaaccaagttcgtctaaggcgcacagcatcccatttgatggaactccccgcatcttactcttcttgatcttagtgtgaccaccaatccatgaattcggtaacgccacgatcaccttttcgccagccgcaacgttaggtgccccacaaacgatttgcaagggttctgattcgcctacgtccacttgacaaacgtggagatgatcagaatctggatgtggctcacacgttaagacgtgccccactacaacttttttcaatccttcactgggacgaataacaccgtcaacttcaacggccgtccgttcaatcttttctgctaattcatcggccggaatgtccagcttcaaataatcgcgtaaccatgtcgtagaaattctcatgtggacgcctaacctttcttatagaactgtgacaagaaccgcacgtcattcaagtagaagttgcggatatcgtcaacaccgtatttcaacattgcaaagcggtctggtcctaacccaaaggcaaaaccaccatattcttctggatcaatgccagacatttctaacacgtgggggtgaaccatgccggcacccagtacttcgatccaacccgtttgcttgcagattgcacagcccttgccattgcaattaaagcaagttacatcagcttctacggatggttccgtgaatggaaagaagcttggccgtagccgaacatcgaattgatcgccaaacaaagtcttggcaaccagaattaaggtgcccttcaaatcagccatcgtaatatgcttgtccacgactaacccttcaatttgatgaaattgatgggaatgggttgcatcatccgtatcacgccgataaacgcggccaggtgacaagaccttcagcggtcctttagaaaaatcgtgattttcaagtgaccgcggctgatcagcagacgtctgcgtgcgtagtagcacgtctttggtaatatagaacgtgtcttgcatgtcacgggcgggatggtccttcggtaagttcaaccgttcaaagttgtagtaatcttcttcaacttcatcaccatcaacaatttgatagcccattcccataaatagatcttccaattcagtaataatctgggtaatcacgtgaggctgaccttgtggaacttcccgacccggtaacgtcacgtccagtttttcggcagccaattgctcattaacggctgcttgttccagttcttcacggcgttcatcaatcgcagcctgaatccggtcacgaacttcgttggcataagcgcccacctttggccgttcttccgggcttaagtcgcgcattccgcgcaatacttctgtaatcggaccctttttaccaagcaaatcaactttgacttggttaacctttttcaaaacatcggcggatttaatatcggccaagccttgatcgcgtaattcggttaatcgatcttgtaaactcatatgctgcctccaatttttagttgcgttgcggacaaaaaaagaccccatccctgaaaagggacgaggtcatcgcggtaccacccttgtttgcatagtagtcactatgcacactcactacccgtcataacggtcgggataccggaaaattatttgtttacacaaacgcccaatttcagctcagagagtgaattcgtcaatcttggtcgccagggtgctttcaatcggtgacacccgtccctacgacgccgtaactaactactatttctcgtcaaggcttttatctacattgtcagtttatggcaaagtgccctgcacgtcaaccccgtattaggattcggccgggctgaaccacttatcagaccagttatggaccgtatccatgacctgtcgtaaatcttgccccttcgtagtcaagcgatactcaatcagggcagagtcacaatgggttacccgactcacaatgccgttttcttccaattccttgagacgaacgaccagcacccgatcactgcacttaggaatccggcgtgccagattcttaaagcgttggggaccgtcttccagtaaaacatcgataattaaaccgttccactttttccctagaattgagaacgtcttttcaaattttggacacagttcgaaatccacgttggattctgttaccgtgtcagctagcatttctgacatgcaatgacccccaattattgaattaaccggcggagaccttgcctcggaaccgatctagttgtttggccactttcatacgtaatggtccaaaaaattcatgttctgcttcataatcatcaactaaagagacgagcaaactttcacgatatttaggcacagctaaagttgcaccaaacatatgcttcaaaatgatatctttttccatcggcgttaatttcgttaacttttcagcgttacgtaacgctacccgcggatgaataaatgcgtgcgagccgagatcaaacttggtttcacgccagtcataataaaacaaatcatgcaataatccaccacgcgccactgccgtcgtatttagatgccatttcttcgctaaaacataactatcatatgaaactgcaatcgaatgatccaatcgatttgaatggtggtgctgtgtaaactcagcaagccgctgaacggccggctgtgctaataaatcttcgacgatcgccacgtattcagaatcttgttgccacgcattattagttttcatctaaagctccctttgctaatatctacggctattctactaaaaagccagtcattttgaaagtattttacctggattttagcattttcttactaattgtaagttagcgatataaaccgaacattaaaacgccagcagccacggctacatttaacgattctgcttgccccttgatgggaatgtataagttttggtctgtccgtgccaataattcccgactcattccattaccttcgtttcccatgatcaagccaaaactagccggcgcgtcaatatctaaataccgggctgcctgtggatttaactctgaaccgtagactggtgaaccctgcgcctgcaattggtcaaccaacttgtcgagatcagtactaaccagttgtaaatgaaactgactcccctgcatagctcgttcaactttgggttgatggatgtccaccgtcccggtaccgaaagcgacgccggcaaaacccgcagcatccgcagtccgtaccatggttccaatatttccgggatcttgaacattatcgagcagtaaccaaggccgcgttaaatctaattgtgatagatcttcaattgcagcaggcagggtcgccagcgcaaacaccccctgcggcgtcaccgtcgcactgatatgtttggcgacttcatcagagatttcaatgaccgctggaaaatgagtcaagtccggttcggtcgccagttgcttggcagtaatgagcaaggtctgaatcgcgacgtgtgctttaactgcttcgttgactaaatgccaaccatctagcaagtattgtccctgttgtttgcgtcccttctttgtttggagctttttccacgccttgacgtgcgcattttgtaatgaattaattttttccatcgtcaacttcctttaattaatcggttgaaacatcagccggtcttgtcaattcggggcaccctgtatcattcgaaagtgtccgttttatcccaagtatagcatatcgcccgttgaacatttccatgctattatataagtaatacagattgtactaattatgctaacacaatacaatcagcaatcagtacaatcaagatgctagtcacaggttagactagctgaacaagttaagtaaggaagtgacacaatgcgtgcagtaacattaaaagcaaccggccgggtccagggggtgggcttccgttgggccactaaagttgccgctgacaaatgcggcgtgaacggaatcgttcgtaacctgatggacggctcagtctttattgaagccgagggtgaagatcaacgagtgcaagtctttatcgacgttgttcggcagtcgccaaccgattttggcaaggtcaagcacctcgaagtgcatgaagttgaaccacaaaactatcacgattttcggataaccaattgaattcccccgacatctttagtatcatcatcattatatgactttaacaaaggggattattaactagtgaaatcaaaaaaaggccttacgctcaccatcaccttaggaacgttagcactgtttctaagcggttgtgtgcaaacgaccaaagctggtaaaccatacgggtttgtttacgagtaccttgcaaagccagggcaaaacgtgatggaatggttgtcacaactattcggtaacaactacggttgggcaatcatcggcttgacggtcattgtgcgactcgttttactgccaatgatgattaatcaacaacgtaaatcaacctaccaacaagaaaaaatgtccgcggttcggccacagatggaaaaaatccaggcacggcaaaaagcagcgacgactcaggaagaaaaagccgcaatcagtaatgagctcatgcaactttaccgtgacaacggtattagcatgactggtggtattggctgtttaccactactgattcaactgccaattttctccgccttgtactacgctattcgctattcgcctgaattatctaaggcgacctttatggggatctcccttgggaaatccagtctgattctagccattttagcctttttatcctacttggcacagggttacctatccatgattggtttacctgaagaacagaagaagacgatgcgtctcatgctcattatgagtccggtcatgattttatttgtttccatgtccgctcccgcaggtttaggactttacttcttcgttggtggtttgtttgcctgcttgcaaacactgatcatcaacttcttccggccacgtattcggcgtgaagttgaagcagaactcaaaaagcaccccatcaaaacaccaacaccgacgcaaccaaagccgattaatgcaactgaatccaagcctagtcatcctcgtccgcaaaataatgcggggcgtggtcggaatgccggtaaacaacaacgacaccgtaaataaccactgaagcttaatcaacactaaagcaccgtcatgaaaattctcatggcggtgctttttacgttgcacctaaccggcacgcagccgtccccttaactgatttcgcaaacattaccacgagatgccaattaacgctgccaggccgatcagatcaatttcttacttagctggtaggaataacccacggtcaaaatcacgaccaacacgataatcgtaacaaagacattgagaaatgagtctgttgacatctttcccatcgctactaacagcggtcctgagattccaaataatctgcctgctagcacattagtccgatgccagttttcttctgacaaataggtccacggaatccggattccaaccaagcgattacgagaagtatatgccatcggtaatgcgacaatcgagatgattatcgcgatcagcgcaaagccaatcgtggaaatccggttgaaatcaataagtaacaaataaaataaaacggtcaagttaatatcagcaccgagatacgttcccttgcgccagttggaattctgtttacagatcaaaattaaactaatcccaattaaaaataacccaccaaccacggccaacggtgcattacgaatttgccacatgggcccaccactggccagtttaatcactactaagatgaccaaattgattaaatttaccatgataagcaatttaaccccaagcgtctgttgccatttttctggaatcatgagtaagcccccattctaaactgctagccagataaggttgcagcgccataattattccaataccgagtccgacgttatgcgtgactaaaacacgcaatcgctgaaagcaaggatgaccagcaaattactcacccgtatgttgcaatcaataattgctcaactagttaagcgcaattatagctgaattgcataataaggggtagaacttgcccactttcaagtttgtccgccaacattccaaactaaatcaaacgtatttcgtcaaaattaatctactttgggcagacgacacttcgagacctgaaattttatgtaaatatgcgataatggaaattaacaattcaaactcaaggaggaactcccatgaagttactacatacagcggattggcacatcggccggacgcttaacggttattctttgttagatgaacaggaagcagcgttcaagcaaattctaacgattgcattggctgaaaaagttgatggtatcgtgattgctggggacatctacgaccgggccgttccgagtaccgatgcggtcacttcacttgaccacatgctgcaggctattaatatcgagcatcacctaccaatctatgccattgctggcaaccatgatggcgccaaacgtctcaactacggtcgtgaatggctagcctataataattttcatatcaatacgttactagccgaggccttcacgcccatcgagaccccaacggcacaaatctttatgttaccgttttttgaccccattgacgcgcgggtctactatcagcaacaaggtttgcccgaaaaacaagtcaaggcgattcacaccattcacgatgcgatgcaacgcgtggttagtgacctcgttgccacctttgatcctgaaaaacggcacttgttgattactcattttaccgttacacccaaagcagatgacgacttggaattaacaagtgaaacaacttccaaagtgggcggtttggcgacgctgaccaccgatttattcgcagacttcgactacgtgatgctgggccacattcacactcggttagcctcacccgacaaagatcgaattcgttatgccggtagccccgtcaaatttaacgtcaaggaagccaaccctaagttccatggcaaaggtgttgaaattgtgacaatcacacccactgcgatcacccatgaattcaagccaattcagccgcaaactgacttggttacgttgcgtgcgccttgggaaacgttacttgatcccaacttttatcagcaacagccgttaaagcaggcttggtttgcgatcaccgtccaggaattcgaccgtagtaagcatctgaacgtccgggcgcaactcgaacaaatctacggcacaattgtcgaactggactacgaatcgaaccaccaagccaccgccattagtggcccaaaaagcatgaacgaactgagtcctgatgcaattgttgggcaatttttccacgcgattactggtaaccagctctcaacgacacaacaacaactcgttgaccagattttcgtcaacttaagaaaagaggattagccgtgaaacccgtttatttagccatgaactattttggcccccacgaacattcaattattgattttagcaagctagaaagtaccccgatttttctgattagtggtgatactggagccggtaaatcaactattttcgatgccatgacttttgccctctttggcagtacgacgaatgatgggacggatggtcgggcagccaaagagatgcgcagtcagttcgcccccgctgaccaaccgacaagcgtcaccttctactttgagcaaggcaatcaactctataagattgcgcgctcccctgaacaatacttagctaagaaaaaaggatctggactgacgaaaaagaatagtacggccaaattagctgtcgttgatcacgttggtggcgtggagattgagagcattgcaaccaagccggccgacgttggtcccgagatcacgaccatcttgaatttgactgccgatcaatttaaaaaaatcattctactcccccaaaatgacttttcggaattcttaaagtcaaaaacgactgacaaggaaaaaattcttaaaaagatttttggaacgcaactttattcagactttactgcggaacttaaagcggagtatcaaaccgccagcaagactggtgatcagtttgtcgccgatttgcgggtcgcactagcctcagcaacttggaatgatgaggaacaggctcaacttcaagcagttccggacaatcaaaaaattccactactacgagcatttgttacgacgcgtcaaagtgcttttgaccaagcacagcaaacgactagtaaaatcaatcggtctgttaaagcggccgaaacgacctaccagcaagcacgcgatcgccaacaacaatttgaccggctcacacaggcgcaagctgattatcaaactaaagttgaagaacaaacaccggcaattaccatagccaagcaacagttgcacgcgttaacttgggcccagcccttacaagccaccatgcaagccctcactcaacaaacacgtgaccaaaagcaattgacacttgaccagcaagcagctatggataacgtgcaacaagcgcaggacgactatcgccaagcgcaagctgcagttcaacaattacatgaccaaagtgaagctaaccatcagcaccagcagcgcttggaacaattggccacgttgattccacaagcgcaacgcgttgaaagtctcatcgcacagctcgcaaagctcaagccgagtgtcgctgatctgaaggcgacttttgaacagcaccaaaccgtaataaagacattaacagccaaaatcaccacccaacaagcgaacttgccatctattgatgacttacacgccactaaagatttgctgattaaacaacgagaacagttcgtcgacaccctgacaccacttgatagtcaatggcgaggtgcgcaacaagaacagcagcgcgtcaccaagcaactgactgatttacgggcgcagcttgcccgcgatgaacagaatcagcacaatgcgcaagtccaatttgaacaacaacgtggtcaacgccaaagcttaatgattgcccaattacaacaagaactcgttgacggccagccctgcgtggtctgtggatcaaccgatcattcacagatgccggtcacaaccatcgttgcaaatgaagctgacttacgacaatccatgcaagccgttgacgacgctcaaaacgcgctggcggcagccaacaagcaagtggaagcaactcaacaacgtgtcgaacaggctgaaaaagaagttgaccaggctacgcagcaagtaaccaccgcccaaacgcaactaacttcaacttaccaacagttgattgaaaccaacggactagcactaaagtcaccctacgatttgaccgcagtcagggcttttttcgctgagcaactcgccacaattacgaagaagcttgaggcagcccaacgagtggttcaagctattgagaaatatactgctgaactggaagcacaacaaaaacaggcccaacaaacggagttacagttaggcgaacaacgggccttattgcgcaataaaacagccgatttgacggtagctcaggcagccattggtacggacttacaagtcacaagcgctgacctgctggccgaaaaagcgcatctcaatcagatcgtcgcgacctaccaacaacgcctagaggccgcccaagccaccgttcaaaccagtcagcttactttatcaaagcatcaaactaagctcgatgatttaaacgaccggttgaagacaacacaggccacgcgcacgcagcttgagcaaacaatcgcacaggccttagctgctccagaagcaccgactcatgaccaaactgtacttgaaaattggttagaagaactcgccaatggtcgactgaccgccctgcaagtccaaattgccacctatcggcaagacaaggagcgtctgacaaccgaaatcaagcaactgcaaaccgccttaacgaacgttgaacgaccgaatattacgggtatccaagctcagctggccgacctgcaagctcataaggatcgggcactgcaatcccaaaccgtggcggaacaagccttaaccgacgcgcaaagttgtctcgaaaaagtccaacaaatcatgcaccagcaaggcacatttgcaaagcggttcgccgaaattacaagcctgtataatatcatgactggtaaagatggcaacgatcacaagctcaagttagagacctacgttgtccaaaactacttgcaacgcgtcttaaactacgccaatgatcactttatcaacctgctttccaataaccgctacacatttgaactagctgccgaagcgagtgataaccgcagtgaccatggcctcgatatcaatgtttacgataatgagaccggcaactcgcgttcatccaacacgttgtctggtggtgaaaccttcattgctgctctgtcgattgcactctcgctcagtgaggtcgttcaatcttcggctaatggcgtccaaatcgacgcactatttgtcgacgaaggcttcggcttcctggatgatgaaactttggaaaaagcgatgcaggcactcgaaacaattggtgaaaaccgaatggtcggtgttatcagtcacattgaatcaatgaaacgaacgattggccaacaagttctcatcaaaaagatgggggatggccgcagtaccgtgcggttgatcagtaaatagccgccgaaaacaaccgcagtacatgactaacaaggtccaaaaaacagcgacacaaaaaacggcggccgtcattcagcaattatgctggatgacggccgccgtttctgtgaaccatcccaattaatcagaccggattaaaagaaaatacccaggatcagtccaagtaattgcatgccttgaaacatcatcaaattttgtggtgccgtattaaaggtggtttctttcacctgcaccgcgttaaaggcccgaatattcttcaaaatttttggtaaaacgagcaacactgccagctgataaatcggtagtatttgtaaaacaacactcatcagcactggcaaataacctaacagcgccagcgtatcgtagacccgtagtgaccaacgatgaccaatatagtacggaaccgtataacgttcattgcgaatatcctgttgtaaatctgaaatattatcagctaacatgatattcgcaaccaagaaaatccctggtagccccaccaaaatcatgaccaatatgttctctaaattccccacaatcgcaaactgcggccaagcaaacttaaagcccgccagtacgggggtcgcgacgttcatataaacactcagaaagaaaacgccaaatccttcgacacatcccgacagtaattcacccaacgggaagcgcgaaaacggtaccgggccataggtatagaagatagccacaccaatcgctgcagcgcccatgaacagtaacaataggtttgttctgacgactagcactaatcctaaaataattgcagttgctaacatcgctagcatcaaattcaatgatcgtcgtggtgataggtgctcacggccaacaatgttataagtatcccgataatgtaaatccttagccaagtagtaatcctgcacgttattaaaccccgtcacaaacaatgcaatcgctacttgtgcaactaagtaaattaacgaattgatccaattaaacgcatgaaaataatagattgaaaataaaataccaataaaatacggcaccacactagctgccttggcatttagccgaatgaattccaaaaaaattttgaacgtcattggccgataagttggttcgttcgtcaacaacttcgccccctgattaaattaactactcttccactataccaaaaaaggttacttgtgaaaatggtttcatgatgaacataccaacaaatatcggtcagcttaaatatatttcgagtcggatcaatctgaatcaggattaaacccagcctgctggtgtacaacctattcgtcgtttaatcagcatcttactgcgccctatcgaactgtcagtcgatgctcaatattgatccaggcctccctcaaaatcacgatatgatcccataggccgcggctttaaaattcattacagcgcaattatccatactgaaaacgcacattcaagttaaattaacttgaatgtgcgttttaaattcatcaatgattcgattacctagtggtcgtgctcatgatcatccaagggcgcttcatcttcatcacgagtagctggtcggattccggctggcagttccgacttggcaatcttttcaacatcattcgtttcagcctcggccttagctaagagcttcgcgtcccgtagaatcggtaactggaaccgaaagatcgagccttggcccaccacagattcaacactaatatgaccatggtaaccttcaactaaccgttgcgcaatggataatcctaacccgttaccacccttatcacggctacgcgccttatcaacccgataaaaacggttgaaaactcgatcgagattgtccttagaaataccctcgccaaagtcttggacggcgacttcaatgtagcgataatccgtggataatgataaatggatttctttacgtcgtgtcgagtacttgaccgcattatccaataaaataatcagaatttgctcgaggtgattacggtaaatctgagcatacaccggctttttaacatcatcatcaaacgtaaaatgaaagtcgggatgaatcatcgtaaaatcgttaaatgcttgcgtcactaacttctgaacgtccgacgtctcatggctaaaattgatttccaattgttcagcacgcgataagtccaacatttcttgaactaagctctgcattcgcttggtttctgacaaactagccgccaatgattccgacaacacttgtggatcatccttgccccatcgattcagcaactccatatggccctggataattgccaccggggtccgtaattcatgggaaacgtcttcaacaaattgctgctgttgattaatatagcgttgcatctgatcaagcatatcattgaatacgactgctaaatccgacaattcatcattgcgtttaagatcgggcactcgcgagtcagtttgcggatcatcattgaccgcattaatcgtctgtttgattttacgcattggccgtaatagaaacgcagctaagaagtagcccagtagcgtggcaccaaaaatagtgatcattgtcattacaataaagatccagatcaaattctgagtcgttgaatggtattccgccaaattatcagtgacctgggtgtaaccgatcaaacggtgattgctagccgcataaatgggcgcccgcccaactaattcagcatcacttcctcggccaatcaccaccacctgacgcgtcttattcttagagaactcatgtgcatccttgcgggatagatagagtgtgttcccgtgtggatcataaaccgtcacagctaagtttgtgcgggataaggctgttaaatcggaatctgaaaagattttactttgcagcacaccatgcttacgttcactcatggtagttgccggttcaacgctcgcctcgggttgcaatttagcggccaccgacttaatggtcagccctttcgactccgttcgcaacgattgttgcaccgttgtaacagcactagccacgttccgttgttcttggcgcaataagaggttcgtgaaactcttatagaccaataatgaaaaacaaataaaaatgagcgcggacccaattgcggtcccgagcgcccatttccattttaatgaccaacggcgccgtggtttaggcgtcacttgattcgtatcagcgtcagtcattaagaacgaatcacgtatccagtcccacgaacagtttggatgtaactcttttctcctggtcggtcaatcttgttccgtaagtaacggatataaacgtcgacgacattcgtttcaacttctgattcgtaaccccatactttgtttagtaagacatcacgagcgaggacaacgttaatattttccattaaagttaataacagttcatattcacgcttcgtcaagttgatgacttcgtcgccgcgtttaacgactaagttttccttttcaatcgtcaagtctttataagtgacggtcgtttgtttagtgctttgttgttcactttccaaatcgattcgccgcaatagtgctcgtaagcgggcaagtaattcttcgatagcaaatggcttaacaatgtaatcatctgccccatgatccaggccggaaactcgatcaatcacggagtcacgggccgtcatcataataatcggcgtgttcttgacttcacgaacccgccggcagacttccaaaccgttcagttctggtaacatcaggtctaataggatggcatcaaaatcttcagctaacgctgcgtctaaccctttacggccgttatattcgacttgaatatcatagccttcgtgttttaattctaattcaacgaagcgtgcgaggtttttttcatcctcaataattaatattcgactcatttacttttagtcactcctaatattcaacttatctaaaaaccgtacgaatcagtgatttatcaccactaacctgcattaagctagtacaacatgttattttaacatgaaaacgctgaatttcctacaccccaaccagggtctgctcctcacccaaatctaattttagtgaattctcattaaattgcaatctttatgtctcatcatctgacggttcggtttgcggatgttgctggtgccactggcgaatagcagctaggcgctgttgccaggctttctcctgtccctggctagtcggctcatagtaccggtgctgttttaactcaggtggcatcgtcgtcatcgtggttaatttggccgctgtatcatgggcatattggtaatcagaaccataacctaaatctttcattaattttgtcggtgcgttgcgaatctgtaaggggaccggtaaattacccgtcgctttgatatctgcttgcgctgctgatttagccgcgtataatgcattggacttcggtgctaaggctaaataagtcactgcttccgtcaaattcacgtcacactcgggcataccgatcaactggcacgcctgaaagaccgctaccgtcagtggcaatgcctgccggtcagctagcccaatgtcctcactcgcaaaccgaatcaaacgccgagcgatatatagcggatcttcaccgccggctagcatccgcatcaaccagtaaatcgccgcgtcaacatcactattacgcattgatttatgtaacgcggagataatattataatgctcctcgccatgcttatcgtagcgcaacgacttagtattgatcagttgcgataacccggccgtagtaatcgtaacgtgcttgccatcgcggtcaccgttcaaaacagccatttctaacgtattgagcgccatacgagcatcaccattagcaaattctgcgatcaatcttagtgtatcaggctgcatcgtaatctcaatatccggaaaccccttcggattctgcaaagcgccctgcaagacagcttctaacgcatcaggcgtcaatgcctttaagaccaatactttgcaccgtgataatagggccgcgttaatttcaaatgagggattttccgtcgtcgcaccaattaacgtgatactgccgcgctcaacatacggtaaaaaggcatcttgttgggccttattaaaccggtgaatttcatcaataaaaacaatggtcttttcaccaaaatctcgattagcctccgcttcatccatgatttgccgaatttctttaatgccactcgtcaccgcgctaaacgtaataaagtgcgactgggtctgttgcgcaataatttcggctagcgtggtcttaccgactcccggtggtccccaaaaaatcagggatggtaactgatcttctgcgattaattgtcgtaatagtttacccgggccaagtagatgctcttggcccttgaaatccgccagcgtcactggccggacccggtaagccaacggactactactagatttatccgggttaaataatgattcttgtcgcatggcgacccccactttcgcgtttattcattactctcaattttaacgcaaacgtacgttctaatccactcaaaccaacgatcattaccgcacagccacccacagcacaaaaaaactgcgcctaatcacgcgtaacgtcattagccacagtttagttcattcaaaatgattttattgttcttcgtaccaactgtaatggtataacccttcacggtcagtccgttcatacgtatgcgcaccaaagtagtcccgttgcgcttgcaacaagttagcaggtaacacttcggcccggtatgagtcgtagtatgacaatgccgcactaaatgatggtaccggtacaccagcttggattgctaagctaagcacttcacgtgttgattgttgatacttggcggcgatgtcggcaaagtagtcgtccatcaataagttatttaaatcaggcttcttatcaaaagcatccgtgatgttttgtaagaattgggcccggatgatacaaccagcacgccagatttgggcaagttcaccgaacttcaagtcccaaccataatgttcagaagcgaaacgaagttgttcgaagccttgcgcataactcataatcttactgaagtagagggcttgacgaatcttctcaaccaattctttcttggctggcaagtcaacgtcagcggttgggccagctaatttcttagaagcggcaacccgttcgttcttcatcattgagatgtaacgcgcatagaccgcttccgtaataacggattgtggcacttgaacgttcaaggcatcttcggaactccacttaccagttcctttgttgttcccacggtctaagatcatgtcaacgattggcttagtcttatccgcacctaaatcatccttacgtgacaaaatgtcagcggtgatttcgatcaagtaactgctcaattcgcctttgttccagtccgtaaaaatatcggacatttcatcaacggacaagcccgcgacgttgcgcatgatattgtatgattcatcgattaactcttcatcaccgtattcaatcccgttgtggaccatcttaacgtagtgaccagcaccgttcgggccgatgtaagtcacacatggtgcaccgtcttgaggcgctttagcagaaatcttttccaagattggggcaactaaatcataagcttccttttgaccaccaggcatcaatgaagggccttgtaaggcacctaattcaccaccggaaacacccataccaataaagttgattccggatttatctaagcgggcgttacgcgccatcgtgtcattaaagttggtgttcccaccatcaatcaagacgtcgcctttatctaatagtggtaataattcatcgataacggcatcggttggcttaccagccttaaccatcatgataatccgtcgtggcgtttcaagtgaagccacgaagtcttcgatcttataacttggtactaattgcttgtcagcatggtccttaacgaccttttcagttttggcaccagtccgattaaaaatcgcaaccttgtagccgcggctttcgatgttcaacgccaggttcttacccatgacggccatcccaatgacaccaatttgtggtttttcattactcattagtttattgcctcccaatttttaatacgcaactatcgtaccaaaaaacacgctgttaataaagtaaatgaccgcaaattttaaaattaatttcatataatttatcgcgggaagaaattaattttcatagaaccatccaaaaaggttacttgcttttcaaacagcaccaactgacaaagttaaaaacaccgtgctaggcttacagtaaaataaacggataaccttcatagatcggttcgtggtgtttaggctagtgtcctcattgttattatgacgttccgcactttttttattcgtacatgcccgctggtggccacttttaccagagagacaccctagcaccactaatcctgaccagcagtccaattcaagataagtaaggaggcccctaatcatgtctatccaacgactgccagattggcatcaaattgaacaacccgttgttatttcgcttaaaacggcccgtcaccatctctggggcaacgtggccgtttatttgggcttatttattatcgagcttctaggggcacgctggggccactcacaggccctacgtgcggatgcctttaataatttatctggaattttttcgaccgggctactcatgactggtctattcatcgccagtcgcacgcacgatgacgatttatttggcgcacccatcgcacccgcggagcagcagcaattaggaccccgaatccagcaatcccgctttcgttttgagacgatttttaatttactagccggcaccatcatggctgccattggaatcgacattattatcaaaggcgtaatgacattcgccacccgtacccccttcaaaaacctcagcagtatcgccggcttggccgccgggttttccttcgtggtgctactggtcttatgggccttcaatcattattggagtcgcaaacttaacaatgctgccctgaccgcagcgagccgtgataccttcacggacgcgttgaccagtctgactaccgttcttacgatccttgtcacggtcaagctccaccttcagtggttcgataacctgattagtatcggcttagggctatacatcctcaatactggcaccaaaatttttcgagaaagtagtctgaacctagttgactatttcgatccttaccttgaagatcgctatcaacggcgaattgctgatttaactagtgtccgcaaagtcatttttctcaaggctcattatgatggtaatctcatcatgctgcgagccacgatcgttgtgccacctcggatgacggcgattgaaatcacacgtctgattgaaaccatcaatcaaatcatgtggcaagaattcagtgtgatggaaacggacgtgatgattacgactagctattgatcaaatcaatgatttacaaaataggcgatacgtttagccggctgaccatttcaagactagttgctgacaaaatgaagctacttaccgccccttttcaccagcaaccacgtggtactaatcgtcgtgctcagtttccaaaatatgaccttcataggcatcaatcttaatatcgacttgctgctttccttgatgtacctggacctcccagtaagtggtgccattgtccttatcgagcttgagctcgctagcatagccaccgttacggtcatggatggcaatcgccaccgctttactaggactgattaccttgttaagattcagccggtcaccctcagcgtcagcttgatcatcttgatccagcatctcagactgcttactgatgaccttcccggttcgcccattgagttgtaattcatgttcctgggtgccgccaacgccttccagcgtgtaaaccggtcgaccgagttggtcttctaactcaatactcgtcacactggcgtccggatattgttgctgaaactttttgatggctgcggctaatgacactttcgttttggctgtcacacttttggtcgaactactttgactgctagtcgattggcttgtcgccttattttgcgtcgactgttgggtgccacatccagctagcagaaccacggtgagtagtgctaacccgatcccatattttttgctcatcatctccataacccccttgtcgctgcgtcagtaacacttattatgaagccgtacccattatttgatagtcttagtatacggaagggagacgcctcatcgcaatcaatatgcaaagccactcgcttgaccgcgctggcagctcagtcaaaccttatttcaagaagtgctggtcccgactcaaacttaattgaagacaacaaaaaaagcccacctaagcgggctttttgatcgtattatggtaacgaaaagttccatgcgccatggccgcaatgcaacttttcaccaactaacaattagttgtttacttttacgacttgcttgccgttgtagtatccacaacttgggcaaacacggtgtgatacacgtaattcgccacaatttgggcatggtgccaaatttggtgtagccaatttaatatgaccacgacggttgcgtttacgcatcttagatgttcttcttgctggtacagccatcaacctacacctccttcaagtgaattcacataatgtgtgttttgatacgcctagctaacttaatccttgtcttcctgatcagggaacaggttttttaacttagctaaacgcggatcaacagttttaagttctgcagcttgcaacgcttggtcgtcctcggagagaacttcccagcccttaccagttggcatcggggcgccgtcttgttcagcttcagaaagaatctgcatggggatgtgaattaaaatattatcctccacagcgacatcaaaatctaaaatatcatcttcaggtaaaataattaccgtgtcagtttcttcgtcaaaacgactcagatcggttccctgaggaacataatattccgtcatttgaaaagccaatgggacatccactggcgtcagcgagcgactagacggcaatgttaacattgcgtcaatcttcgccgtgattaacacattatccttatcataactcgctaatccagttgcgtgaactgacttaacatcgataatttctggataacggctcatcaaggagtgttttaaatccaatgcttcatcaaactgaagtgacgtttcacggtatgttttaagctgtgaaagtgaccatttcatttaaaaacctcctaatgcaacgtgataaattatacctgtgtaaaaatcctttgtcaatgttttttccttgacagtccaaaatgcccgtcattagacctaaccatatcaagaaagcccgccgtggtcaaccaattgttaccggtaaccgccatggctgccgatataaatcctgcgattgcccattaattaattgatagacgcgccccgcctgataatcgagattcagagcatgctggcgtaagtcttgattgattttcgtatacagcggcaacgggagctgtttcttcacttgatgcaaataagcctgccccttaggtgtgaagcctaagacgcgcagataattatgtgcctgtgccttctggacttctgcctgagtaagttgtagtagtgcggctgtcgccacccgctgcaatcgtgtatacgtatagcgttttgacttgacctgatgaataaagtcatcaaaagtcgtggcgtgttgggccatcgcctgcatccggtattccaagccttccgccatctgatcatactgtccactacgggcaacgtcgacggtcagcaattgatactgtaaaaatggccaaaagtcgctccagcgctgcagtcgttgcgtagtcagtgccgtgaacgtgtcggccgggacaactggtttcagcgccgcccaatcctgtgcaagtgccgcttggcgcaccgctgtcccactggcgtagcgactatcggccgcaattgtcgtcgtcgcgtgatccgcttggcggcgtttgatcggcagtaactgcatcggatgtgccagggcctgattggcagcgtaataacagaagctcagcatatcattggctgccgtcaacgtcacgcccgtggcagcttgcaaggccgcgttaaactgagtggcaaaagtcgcattatagtgggtaaagctgccctgccgcgccgcaattgccgtggccaaccgttgaaagtccagctcaggatgttccgcaccaaaaacaacactcgtacagtccagtgcactgagtagttcaataccaccccgtgcaaataaatgggcaggttgggtcgcaaaaaacacgggcagttcaattactagatccgccccattttccaaagccagcttcgcacgtgtccacttgtctaaaatggccggttcaccgcgttgcagccaatcaccactcatcacaacaataacacagtcggcattggtcaactgttgtgcttgccgcaaatggtagcgatgcccattatgcaacggattgtattcagttattaacccgactgcttgcattcttgttcctcctactacttacgacacttgaagaaccaccgcgtggtctgatcatccggttgttggcggccaaaatcggcgctgaccgtgacatgattaaaaccggctgcctgcagagcttgttgataatcagccaacacataagtttgttcttgatgtaattcactgacctcgtcgaaggcctgcttatcatcattataaataaagaacgttaaatcgtgctcagcactgtgtggctgttcaccggcatagcttgtccacataaaagcccgatcctcatcgcgataattgtacatataaccaggatagacctcatccgtctgataaggtgtaatgacgtcgaataaaaattcgccggccgctgtcaaatgttgagccacttgttcaaatgcacgttggactgtcgtaatatcgggcaaatagcagaacgaatcagcaaaacaggtaaccgcatcaaaggtcccaatttcagataaatcgagcatatccccttgtaatagcggtaaggtcacggctgcctcgtccgcatggcgctgtgccagtgctaacatgttctccgacaaatctaaaccggtgacctgatagccggcttgggctaacaacacccctaagcgtcccgtcccacaagctaattcgagcaactgaccatcttggttaggatactcacgacggacaaaatccagccattgctggtacatggctggatcaaaaagttcgtcataaagttcggcaaacgtctgataaatcatgcgtttacccattgtgcaacgtcgacgatgggcgcatcagaccataatttttccaaattatagtgtgcccgcgcatccttttggaagacgtgcacgatgacgtcaccggcatcgatcaagacccattcgcccgcagtccgaccttcgacgctcttaacgtccgaaccggccttgcgcacaaagtccacgatattatcagcaatcgcttgaacttggcgcttggaatccgcggataagatgacaaaatagtccgccatcaaactgacttccgcgacgtctaaggccacgatatcgtcggcacgcttatcgtcagcggcctcaacagttaattgtaaaagttccttgctatccataaaactctcccttaaatttaattggcaaattgaggggccacaccgccgacccacgcgttataggttgctaacgtttgtgggtagactggcgcacccttctgaatcagataatctagtgtatgttgaatctggaaacgaacaccgtcagccaacgacttggccgtcgcttcacgagccgcttcaacaccggggaagtcccgggctggttcaataaaatcggccatgaagatgatttggtccagtttagtcatataaggcgcaccgaccgtgtgtaaccgcaccgcattcaaaattggctcattgtagatgtgcaactcatctttgatcagttcagtgccaacatagccatgccagaccccgttcccatacgaaaccaggttggggtccatgccatgcgtcttaatgagctgaataaatgtttgatcatcgcgttgcttggcgtagtcgtgtaataaccccgcaattccagctaactcgacatcaacaccgttgtcagcagctaactgtcgcgcagtctcctcgacccgtaagcagtgttgatagcgtttgtcagtcaactgggcggcaacttttgccattagctcctcgtgacgatatggaacaatcgcttcagtatactcaatcgttttgctcatacaaatgatgctccttaatataagcggccacggcttccggaaccagataacggaccgaatgcccgtggctgattttttgacgaatctgagtggaactaatatcgatcaacggtgcgtcgacccaaataaccggatattgactcgtcgttgggtacccggttcgtttgataccaacaaaggtgactaatttaactagctcgtcaatgtgataccaagtatgcaaataatcgaccatgtcgccgccaatgatgaaatagtactgcgtgtccggatgcttagctttcaaaaacttcatcgtttcgtaagtatagcttttgccaccccgctcgatttccgccgtctccaaccgaaatagtggattatcaacaatggcttcttggaccatattcgcacgatcttccaccgcaatcgtcttcttttcgtcgacatgcggtggttgagcgtccggcataaagcgaacttcatccaaacccagttgatcaccaacttgctgggccatgatcaaatgtcccaaatgcggtgggttaaacgtgccacctaaaataccaacacggcgatgcggaattgccgtcaccgtttccgtcagaacttttgtcgctgtttgattaaccgtctgcacccgtcattcctcctataacttagcaacttccaatgaatagtgctggtcttcttcatgactagctggcaagtataagactaacacccggccaattgtttgaacgaccgtaatcgcggttttctgttcaattgcagctttaacttcagccgttgtcacatcagcattttgtaaaatgttgactttaattaattctcgcttatccagcgcacccgttagttgggtcaaccattcgtcagtcaagccgtttttcccgacagcaaatagtggccgcatgtggtgggcttcaccacgtaaatagtgtttttgttttccacgtaagttttccattaagtttgatttactcctataattttctgtttgataatcgcgaatcagattctactccgaccacaactcatcaacgcttgttgatcatagctgggcgcgtcaagactgcaacaccctttggtgcccaggccgctacacgcgtatccgcagccaccgtgacccatccgaggccttcaaagacaatatcactgatttccgtcactttgaattcgtggcgaactaatggtggaaagtcagcgacagcatcgccagttgggggggtaatcagttcacccacatgcttggtataaaagttgtccgcattctcggtccgggttcggtgcaaggtcaagttattatcaacgtagaccgtcccagttgcttttaacgtatcaacaatatctaaccgtgccaccccacctaagaacaaagtttgaccgttacctaattggaagccctttggtcgaatctcgcgttgtggtgagactaacttcaggtcatcgcctgataacacgtgggccatctgttcaggatgaataattccgggtgtatcaaccatcatatgaccatcatccaacggaatttcaatcttgtctaacgtggtccctgggaaccgggatgtcgtgatcaagtccttcaaaccagtattgttggcaataatccgattgatcaacgttgacttaccaacgttcgtgacccctacgacataaacatcgcgtccacgacgatatttttcaatcatcgccaagagttcatcaatggaatgccccttcttggcactcgttaacgcaacgtcgaccggtttgattccctgtgcacgaacttgttgattcatccattcccgcaatttcgtccggcgtaactgacgtggcaacacgtcttccttattaccgactaacaaaacgggattatccccaacaaagcgctggagaccaggaatgatacttccattcaaatcaaaaatgtcgacaacgtacacaaccagtgcgttcgcatctcgaatcgtggctaacaaatgacgaaaatcatcatccgttaagccaaccggcacgatttcgttatagtgccgaagccgaaaacaacgttgacagtataaatcctgtgcttcactagctaatgatttttgtaacgcactgttcggtgtgtagccggccgccttaggatcggtcgtttgaatcgccgcaccacacccaatacagtataaagtttcttctgatgtttcactcacttattaaggtcctcctgaaaatgcatttctggataaacatgtgctaatcgtaatttgataaatcgttcaaagaaacggtttatccgggtattccacgcgtctgtcttcacgattggctgtactaagatactgggcacgcctgcaagatgggccgcccacatgtcggtgatatactgatcgccaaccatgaccacttcatttttgtgtaagcccaggtcatgacgcgccttactgatccccagcggtagtggtttcagtgaccgcgaaacaaatggcagttccaggctttgtagcgccttagcaattcgcgcttcagaattgttcgacaccaccactaacggaatgcccgcgtcttgtaacgcgtgcagccactttttcagttccggggtgccatccggattgtcccatgcgatcaacgtgttatcaaggtcggtaaataccgccttaatgccctgcgctcgtaactgcgccggtgtcacattgtagattgctggtatcatccaagttggtttaaattgcttaatcatcgttatccccttcgcttctcgctggattttttggttattggcataaccccactagcccattttatcatactattggtgaaataccggactaaatcaggtctggagccggatttcactaggcaattgtgctaaattttagtcatcattatataataatttgttttttgaaaataagcaacgaaaatccttccaagttgtcgtaacttgatgacaccacctggatcaaatttgactaagttgatcgcacccgcatttatttgataggttggggcccgagtaagacattgaaaatagcactaaaagtcgccagtaaattcagcgatgttttgccggttgcccttttctcgccagtttatttgcaatggctaaaccacaatctgacattcaatcggcgcactaaccgttttgtcaaattagattaacaaagtatcccattaagtgtatattaattaaagatacgtggcttttacttatatcatgatactgatatgtatattgattgcacatcaatgcaatcctcatgtaagcttattgacatggttaaatgttcagattgttctaaaactgttcatcgcagttaacgttaggcaccctggtgttgttctgtgtcgataaactgacaatatcagtaatgatataaactatatgatccgcacaatcactaaataatatgtcatctcggaggttcgtttatggagaaaaaagatgttatgaaacaatacgttaccgataaatatttttccaaggggcactggtggacgaaactttggcaaaccctagtcgcaattattacttggatctgcgttgccgtacctgtctactggactatctcgtcaacgttacttgcgaataatccccagttcattcacgcctggaaatacgaagaaggtaagacgctgttctacttctttgaccggttctttattattgcgtttatcttaatcgccattgtggtcattgtctccacgattcacaataatcaccgggtcaagcagcatatcagtaaagaacggcaatacaacgaagaccagttagatattcggaagcggcaactaaataacttttatacccaacgattcgggcaggccacttttcggcaacacgtcaagcactacacagttgaccccgaacaaaatctcgatgttaatgaaatccacagattgtatgaggactagccaatggaaataatgcaaacacttaagcccttcgaaagtatctggaactttgttctattattattagtctcctacccgattctcggtgcgtttgcctggtttatcggcgttctctgctaccagctgatttaccgtcatcgccacaaagacgatattgaatttaaacaactaacacctgcagaacaaccctttatcacgatcatgattccagcgcataacgaagaagtcatgattgagcacacgatcaactacttaatgaataatttaaattatgaaaaatatgaagtgctggtcacagatgatggttcgactgatgagactccggctattctggaacgtctccagaacgtgtacgacaacctacgcgtagtaacgatcaagaaaaatcagggtaaggcccacgcgttcaacgtcggtgtcggctttgcccgtggtgaattcattttaagtaatgacgctgattccattccagaacccgatgcactgtggaaatatatgagttacttcatgggcgaagaacacgccaatacggcagcggtcacggccaacatggacgttcagaaccgaagcacgatcatcgctaagtcgcaaaccgtagaattttcaagtatcgttggtgttatcaagcggagccaagtcagtgctttaggtaacatgtatgcctatagtggtgccaatacaatgtaccgtcgtgacgctctgattgacgtcggcttattccggcaagatcgcgcgaccgaagatatcagtattgcttgggatcaccagttgaatggttggacgaccgttttctcgccagacattctattctatatgaacgtccccgagaatctagacgccctttatcatcaacgcaaacgttgggccaaaggtggtaccgaagtgctgttgaccaactttaaacgggttgtcagtcatcccggtaagtatttgaagcaatgggcttttattactgatcaaacactgagcatcatctggtccctattcttctttgtctcaacactgatcttcctgatctcgctcgtcaccttcttctttactggcaattacgagcgcgtctatcatatgttctgcatggccttcatcttcgtgaccttcgaaatgttcgccggcgtcttgcagctattgtccgcattgatcgttgacgaccgtggccgcaagtttaaatatctgattttcatgccactctacatgctgatttactggcaggttaacgccctcgctctggtcactacgctgattccagccgttaaaaccatcctgggttacggcagcggcacctgggtcagcccagttcggaagcaccacactgaataattgagaacacaaagcgagccttcaattgaaggctcgcttttttgttgtgcgggactgtgtggagacggacccaaccttgcatgtgcgagaataggctagttagcaacgatttgaacgcttacaattttactattcttcatgtatacgaaagtggtgttataacagctacaatcacacgtactaaatagatcaaaaatcatttttatccagttacctgcaccctcctaccgcctaatcgatggccgccgacgaagtatcaacgctggcttagttacctgtgcgcgttggacggttgctcgagctagttcatactgtgcgtcaataattcgttcagaatcatatggcgcagcatcctgagccaccgacaattcggtgcagccgagaatgacggcgtcacaatcagcagcattcaataattgatcaattaagccatgaaatttgacccgatctacaaaatcacgttgcttgatgtcgtcataaattaaggtcatcacttgagcttgatgctgcttattgggtatgacaggaatatgtccattagaccgaataagttgttgataaagttgcgactctagtgttcccgttgtcgctaaaataccgattcgtaacggtcgcggttgctgtgatcgacaggctgctgttaccgctaaggccggcatattcaaaattggcacgttagaaagcgccgtcaatgcgggaacgaagtaatgtgctgtgttacacgtcatcacaataaacatgacccctaattgattaagtaactgcacatccgcttccaatgatggtaacgggttggcacagttatgatccaaaatatatgcggtgcgatctggtatctcagcatcatttaaaatgacgtagtttaaataatcctggtcacgatgggtaacggtcagccggttcacggtatgcacaaagtcctccgtcgccattgttcccatcccaccaatgattccaaagcaatttttcataatggcacccccatttagcgaacgagattcacggccatgctgcacttcattaagttgttaataattatctaacatgcacctcctaacaaacaactaatccacaacccatctcagacttaatacggtatcattgcttactgcaaacccatgattattcaagaaatgctgccaaacagtgatctatcggtgtactttttacgtcagactcccgttttattagattagaaaacaactaggctagtaaagaatcacatcaattctttactagcctagttaaacagtcactattaatgcgagcaaggcaccaagcacaatcgcccctaacaaagccggcaacaattccttgaaactcacactatgcccgttctcacattcctattgacgaggttttccattcactgaattatactgtcggccccacgtctccatagccataatcaccggtttcaaggtctgaccaaatggcgtgatccaatactccgttttcggtggcacgaccggataaactcgttttgcaatcaccccgtcttgaaccaattcttgtaactggcgagctagcatccgccgcgaacaacccggcagtcgtttttgcaaaatgctgaaccggcatgttcctgccgtaaataaatgatacaaaatcacgctcttccacttgccagcaataacttgcaaggtactttcaaccggacaacccggcgtacaatcgtatacttgtcgctgcatctaacttcccctaccttaattaagtgtcttgattgtagcacaactttgccgtcagaccggactaataggcgtgacaaatatgtccctatgtggcaaataattcacgtcttgtttattcctcactggtaacctatagtaatgtcatgaaaggggtttgattaataatgcatgcaattggttttaccgaccacttacctattgaagatcctgctagtctacgagacgtgacgattgcaaaacctagcgctcaaggtcatgacttacttgttcaagttcaagccgtcgctgtcaatcctgttgacgttggcgttcgtaaaacggggcatgagcaccgcatgcgacccaagatcctcggttgggacgccactggtattgtgaccgctgttggagaagctgtcaccctgtttcaacccggcgaccacgtcttttatgctggctcatttagacgtcccggctgcgacagtgcttatcacctggttgatgaacgccttgtcggtcacgcccccgcgacattaacaaccgctgcccgtgcggccatgccacttacttcgctgaccgcatacgaggcattatttgaacaacttcacattccttttgacccagctaaacctaattccgaaaaatgcaatcaaaccattctcatcatcaatggcgctggtggtgtcggttcaattgctactcagttagcaaaattagcggggctcacagttattagtagtgcttcacgacctgaaagtatcgcttggacgcagcaacacggcgccgatttagtcgtcgatcatcatcatgatttggttagtgaagtacatgctttaggtattaaagatgtcgattacatcctcggattaagcgatcttgacagtcactggaatgagatatgtacgctcattaaacccggtggccacatcgcatcaattaccgaaaatcggcgtccaatcgaccttaaaaaactaaccaagaaacgcgggacatttgcttgggaatggatgtactcaaaatcctactaccacacggccgacatgattagtcagcacgatatcttagaaaccattgcggatttacttgaccgtggcttgcttcaaagcacgctatcgcagacactacggccaatcaacgcgcttaacttgcggcaggccaatcaacttatcgagcaacatcatatgattggcaaggtagttattgaaggatggaaatgagttgacgggtattacggctcgcgcgataatgatcaactttaactcgccaaatacgctgtccttttctgtcttttagtgcttacaactgatgttgcactccccgggattcgtttaatctgttttccgtatacacggggggtaattccaagctattaatctccccaagctgactcaataccatctacgaaacaatatcgcctttctcattcatcaacaagcatgaaaacttaaatcaatacgccttcaacccatcactcgagccaacgtcaaacctatggtatcagactcactcatttcagcatcgttccccgctaacctgccaaactttctttttcagtttccaaaatattagtgctatgatgatagcatcaatttgactaaaacacttaatcagaaaggactttgaaattggcatttaaaacaccactggctgatcaaatgcgcccgcaatcactggaacagatggtcgggcaacaggatctgttgaaggcaggccagccattacgccagattattgatcaacatgttaatattcccctcattctgtgggggccgccgggaactggcaaaactagtttggcgcagattattgcgagtcaagacgattatccattcgtggcttttaatgcttcgaccgaaaataaggcacagctgacgaaagccatcgcacaatacccagagcaatcgtttgttctattaattgacgaaattcaccgaatgactaaaacattgcaggattttttgttgccctacttagagaatgggcacgtgatgctaattggctcaacgaccgaaaatccgattatgtcaatcgttccggccattcgttcgcgctgtcaaatttttgagtttcaaccactgagcgatacagatatcgagattgctttacgccgtgcggtaaccgacatttacaacctaaccgacgatcaggtggatgctaaagccctcaacctgattgctatttcggccgaaggggatctgcgaattgcgttaaatatcttggaaacgctccacgctattgaccagaagcaaatcactgttgctgcggtacaacactttgcccagcaacagcattttagctacgaccggaaggcaactaagcattatgactatctgtcggcttattcggattcgatggctggctcagatactgacgcggcgctctactacttaaccattttgttaaaaaattatgacttaccctcagtggtccgccggctacgtgaaattccatacacttatatcggcttagctaacccggaacaggtcacacaaattgtggtcgctgccaatcaagccgaaaagattggcatgcccaaagcaaaatatccactaatgtttgccaccatgctgatgtgcatttcacccaagtctggttcgtttgaccaatcttgggaaaaactagaccaggacacacaaaatccaagtcagcaccccatgccccgtggattgcgcgatatgcactacaaacactccgaggaaattacaggtggtggtctgatcgataatccatttcaaatgccacatcagattgcccaacaaaactacatgcctaaaggattggctggtcgtcgttattattaccctaaagataatgaaaatgaacgcaaactcggtgcacaatacctaaaactgcatcgctttatttataacgaagattatcacgaatagacaatggcagactggcttaaccaatcagaaatcacactcgattttcataaatcagagtcgcgcactaaatggctcacttaggccgttatccacgtatactccaagcggcatcaaaaaatggactcagtcaaatgaccaagtccatttttatttggcatcatcttttatgaatcagtgcacgccagagaccaagtcaattcgcgtcacactattatgccaaagctcttgggccgtataaacatccttttcgaacaacacgacagtgccatccggttcaatccgagcattggcacccaaccattcccaagatgatattaaccacaaattgcgccgcttccccttacccttttttggtgaccacgcagaaacatagtcatcaatgaaatgtgtacgcatgtatcgaaactccccattatcaaactcaatctgcaagatgttggcgcccatccagaccttaactgctttaggtaaaactgttgccatgatgacaccccttctccaaagctcccagccaaataattaatcaacacataagcaaacgcttacatcgttactatatcacaataatgtgtcaaatcaatctcaagattcagtaaggacgtcaacacacagaaccatcttgtccaggaatcgtgttcccttaatcaagcgtcaaaaaaacggccgccacccatacaggatgacggtcgttcaaacattagagcaagccctaattaagttttaaattaagcaagtgcctttttagcagtgtcaaccaatgccttgaaagcatcagcatcgttaacagctaaatcagctaacatcttacggttaacgtcaacattagctaactttaaaccgtgcattaattgactgtagctgatgtcgttaatccgggctgccgcgttgatccgggcaatccaaagacgacggaagtcactcttacgccggcgacgatcgcggaaggcgtataggtatgacttcattacttggtccttagcaaccttaaattggatgtgcttagcaccacggtaacctttagctaattttaaaatccgtttgcgacgtttacgtgttacagttccaccttttactcgagccatgttatttcctcctagatttaactaaaacgttgtgaattatttttgtaataacttgtggtatgtcttgaccattggcttttcgataatagccgtaccacgtaattggcgacgttgtttcttagtcttaccatggaaacgatgactagtaaaagcgttggcgctcttaatcttacccttagcagttaccttgaaacgctttgcagcagcgcggtttgtcttttgttttggcataatcaataatcctcctagaaattacttatctgtttttggtgctagtactaggaacatactccgaccatccatcttaggataggcttcgaccgtagaaaattccttagtagcttcaatcattcgatttaagacttgccgaccaatatccttatgggtaatagcgcggcccttaaaccggatggagacgcgaaccttgtcaccttttgacaagaacttttcagcatgtttcagcttcgtgttaaagtcattggtgtcgatagctgggctcaagcggacctctttgatgctgaccactttttgcttcttacgggcttcccgatccttcttttgttgctcgaaacggtacttcccataatccataattctggccacgggtggtttcgctttcggcgcaaccaatactagatctaaactagcgtcttcagcaatctgcattgcttcttgtcgtgacttgacacctaattgttcaccatcgctggcgatcaaacgtacttcgcgagcacggatgccgtcattaaccattgaatctttagctatggtaattcacctccgaaatattttagagaaattcacaaaaagagcgggcgcatagtacgcccgctcaaccccgttaatgggaatcaattcatcgttcatctgcccgatgactctggtcaccaaggcgagaagcgggtgcttctgctttttttctcaactccaatatattaacaagaaccacggcccttgtcaacccatcaatcaatattgatgccattggctgttaattatttgcttgcaccacgactgtaatgcttgatttcttgcgtgatggcaccaatgaacatgtcaacggcttcggattcagtccgttcttcaccgtacttccgaactgaaacactcccgttagcaacttcttgatcaccgacaactaacaagtatggaaccttcttcgtttgtgattcgcgaatcttgtaacccatcttttcgttacggtcatcgatacttacccgaacaccttcagctgccaaacgacgacgaacggtttcagcgtaggcaccgtgcgcaccattgttaactgggatgattgttacttgcttaggtgctaaccaggttgggaaagcacccttgtaaatttcagttaagtaagcgacgaaccgttccatcgttgaaacaagaccacggtgaatcataactggacgatgttcttcaccatcagcaccaacgtacttcaagtcaaagcgttctggtaacaagaagtccaattggatagttgataaggtttcttcaccaccaagggccgtcttagtttgaacatccaacttaggaccatagaaagcagcttcaccttcagcttcgaagtaatccaagcccatatcatccatagcggacttcaacatcttttgactgcgttcccacatagcgtcatcatcgaagtacttttccttgttttcaggatcacggtagctcaaacggaaccggtaatcagaaatgtcaaagtcttcgtatacttcaaccatcaaactcaagatctttttgaattcttcttcaatttgatccaacgcaacgaaggtatgaccatcgttcaaagtcatttcacgaacccgtgataatccagttaaggcgccagacttttcgtaacggtgcatcatgccgagttcagcgatccgcaatggtaattcacggtatgagcgaatgtgatggttgtaaatctggatatgtgatgggcagttcatcggccgtaattccaattgttcgccgtcacccatgtccattggtgggaacatgtcctcacggtagtggtcccagtgaccagattgcttgtaaacgtccaagttagctaaaactggcgtgtatacatgttggtagccatttgcaacttccttgtcgataatgtaacgttcgatttggcgacgaatcgttgcaccatttggcatccagtaaggcaagccattcccgaccttaggatcaacgaagaataagtctaattcgttaccaatgacccggtgatcacgttcgcgggcttcttgacgccgcttgaggtcagcatctaagtctttttgctttaagaaggccgtcccgtagatccgttgtaacattggattgctggacttaccttgccagtatgcaccggcaacggataataacttgaagaccttgactttccccgttgaagctaattgggccccgtcagataaatcaacgaagtccccttgcttgtaaacaacgacttgatcattgttggcagcggcacgttcgttaactaagtcttgttggtaagggttgtcaccaactaaagctaaagcgtcagcctttgataagacttcgcgttcgattggtaaatcttgtttgataattgcagccatcttatcactgatggcttccaaatcatcttcactgacttgtttaccgtcttcgtcaggattgtcggtatcaaagaagaaaccgttggcattcccttcaccactcccaaaatgaatgttagggaataattgtttaaccgcgttagctaatacttgggcagccgtttgccgtaaaacattgaggccgtcttcactatcagcagcgataatttcgatactaccatcggttgtcagtggttggcgatagtccacgatctgatcgttgaacttaccagcaaccgaccgtttagccaatgaaggactaattgactttgcaattgcttccgtcgttacgccggcatcaaattgcttttcagcaccatctgggaacttaacattaatacttgccatatacttgacactctccttaaaatttacccactcaccaaaacaccgcgccgggacgacaaaaaagtccctaatgccagactgaactagcattagggacgtcattgacgtggttccacccgatttttcagtgtcatcaaagacactgactcattagcgctaataacggaagcgttccggctcaattgagcatgttcacaaaagtggtatcttcgtaaacccggtccaagacttccagaacaaggtcttggtctctgcaatccatggtaaacaaagcgtgtcttttgcatctgttttcattaaaccacttttaaactaaaagtcaactcttgattttaagcatcgggattgagtcgtcgattacgaccgaccatctcaatctcactcgcaaggtaacgtacccgttgcatgattcgctgcgctttgactggttcttcatcacccttttgtgagagcgtcaaataaccatcttgcaattcttgcatcgaaaaattagacgagaaacaagttggcagttcctcctgcattcgatactccagaataaccccgagcacatcgtcccgaatccaagtcgacgaagcatccgcaccgatatcatcaatcatgagaatcggtgcccgtttaatcgcatcgaccttatccgccgacgtattgttactaatcgagcgcttcatctcgaccgcaaaactcggaaaatgaatcaaggtcgtattgaaacccttagctgccaacgcgttcgccatcccaccgagtaaataagttttaccgacaccaaatgagccgtagagatataagccccggtgaaaacgcttgggcgcttgtgtataggcatcaataaaatcaagtgctgccattaatgctgtcgcccggtcaccatcttgatcatacgtctttaagtccgccgtctgaatatttttcggcatgctgattgatcgaacccgctgttgcaatgcgtgagcagcttgctgttcttgcatttgtggtgttggctgataagcaatgtcaatcaagtgattactcatcactaatgtcggctgatacccaggtgcttgagttggctcgtgccgcgcaattttacgtttctcttcacaaaattcatataatttagccgctgaacgttctagcgcatccgaagataattcgttttgatgagcagctaaaaactggcgaacatctggatcttggtacacagctgtcattaacgcctcataccgatgattcaagtttttccgattcattaacgtccggagtgtttctgagatattctccatgttttagtcctccttttccgaatttgtctcaagctttgctagtcgatcagcaagctgtttgcgttgggcagcagtaatttgtttaccggtctgagctggttgcttaccactctcagtctgttgctgttgttgggcccactttggcataatctccttacgcgtcggtcgattgttcttgcgccgtgttggtgttgatttcggctgtttacgttgcttcaaatacatcaaagccgcttccggcgtcgtaatgccgtgttgttgccaatcattggcgactgtttctagcaaattacgattaagggcagctaactcccgattttgcaataagtagtagatcaccatgttgatgacggcattgggtaataccccccgaccaattaaatcatgaactagtcggttctcaccgctcgtcacaaaaccatgtttctcctgcttcaaagctgataaaaagtcatacggcgctgtctgcttagcatacgtcacgagttgctgctcagccgttgagagctgtgctgaagccttgttatccttagtggtcgtcgttgcaaccgttgcttccgtagcgacctgctgactcgaaactgcgggccgttcatagcgccgcgcaatcaataatttcaattgattttcatcaaactgacccgttgttaaactagccacttcactgattaacttagccatctcaatctcactgatgccgtagacccgactttccgtaatgatcagttgccgtgaactcgcaacctgtttgagatcaacatagttctgcttcaaaatttgccccaacagttgccagtcaaagtcatcgtcactgagcacgggcgagtgatcctcggccggttcattggccgccaattgggcgcgcaccttttgcactgaaagaggtggcgtcgtaactttttgactatcaacgtgaaacacatctaagatatttgccgtcacgtctttggcagccgtcaagtcaatcggctgtgctgcaaaatcgccagcaagttgttgataacgtaactcaccgaccgtatctaacaataggacactcaatagatcatccgcaaagaattgtaacgccagtaatggtgcttgtaattgataaatgtacatggcacccaattcatcttgttgataatagctgcgcaacaagccagttgcttcaagtttacgccgagccgctaacaccgtcggcaagtccacatttaggatgcccagcagttccgcgtgactgcgtcgattgctcagctcattctcgctactctgtaagctacgtaacgccgcgtacaagctatatgccaatggccccatcagtggcaagtataattccgccaatacagcttgttgcgccgcactgagcgctggtgcttgcgggaccactaacccagttttgggtgttaagggttcatcatttggcatgttgttcaccattctttttaactaatctttttttcgtttaggtgcgtgggtcgtcttcgctgacggttttgccagtttgaccttatcacgctccatcatatcttggagttcattcaagaagacgtgcatatccttgaattgccggtaaacactggcaaaacgaatgtacgaaatttcgtcaatatctgccaattgctccatgacatactcgccgataacttggcttgaaatttcattttcgcccagtgaccggaccttattttcaacatcatcaacgacgcccgtcatggtttccatgctaacgggtcgtttctcggccgagcgaataattccgcgcaagactttttcacgattgaattcttcgcgggcaccatttttcttaatgactaataatggcgtggcttcgacccgttcaaatgttgtgaaccggaacccacagttttcgcattcccggcgccgtcgaatcacgcgaccatcatcagttggtcgactgtcaaccacgcgggagccattatgatgacaatgtggacattgcatagacttctcaccccttgtaacaactaacaatcagtttttctttatttagtaatagttttcagccattttaacacggctgctttagttttatcaatgttggccccgttatcaatgacaacgtcagcccttgcgaccttctgtgcaagtggcatttggctgtcaattcgtgcctgagccgcctgttgcgataagtggttacgcgccatcaaccgctgcaatactacggcgggtgatgccgtcacaaccaacacttgatcacaaacatgttgccagccactttcaaataacaacggcacatctaaaataattgcgtcgggctgttgctggtttgccgcgacaatcgcttcgaacatcgcgtactgaatcggtaaccgtgtaattgcggttaagtcttgtaaagcttgagcattgttaaaaaccaactggccaagccatggccgattcagtcgcccgtctgccagcactgcttgctgaccaaagtgcgccacaatcttttgggtcgtcggttggcctggcccttcaacctgccacgcgattttatccgcatcaacgattggtaacttagttgccagcagcttagaaacagtcgacttaccagtggcaatgccaccagtcaatccaatcaactttgtcatcttgatcacctacaaccgttgttctaacgggcaaaaatgggtccctcgctgtgccactttgattttctcaataattgtgccacaccgttcgcaaggttccccttcacgaccatagacgtgtaagtgattttgaaactgaccggcttcaccaaatgccgttgaaaatgaatgaacagtggtgccgtgacctttaattgccatcgccatttcatcaataatgttttggcgcaatgttgcaatctcatcagtagttagtgaattagcaggccgcattggatgaatcttactcatccatagcgtttcgtccgcgtaaatattcccaatgcccgcaatcttactttgatccaacaatagtggcttgatcatctttttcgacttgccaaaagtggccgtcatataagccagtgttaactgttcagcaacgggttccgggccaattgtccgcaatcccgccaccgtgttttcttcaccggtcggcacgagcgtcattcgcccgaacttacgcgtatcgttgtacagcaaatcacgatcatcggtcagatggaagatcacgtgcgtgtgtttaccttgatcttcacaacgcggtacaacattatacttgccttccatccgcaaatgcgacaccatcgtcagaccattgctaaagcgaaacaacaaatacttcccccgccgatcaatggtctggatcgtttggttggctaaacgctgtttgaaactatcgacatcattattaataattttcggccaaaaaacctcgatactagcaatcgttgccccgctaaccagacgatttaagccgcgacgaacagtttcaacttcaggtaattcaggcatggtggttccccctattttgcatcgtaccaagtatcaccgtagtggctctcaacctttaacggtacggctaactgtacggcggaatccatcacgcttggcactaatttttctaaaactggaatttcttcttttggcgcttcaaaaatcaattcatcatgaacttgtaacagcatggttgctttcaaacccgcagcctgtaacttatcttgcatcttaatcatcgcaatcttgataatatcagccgcactcccttggatgggggtattcatggctgtccgttcagcgaatgagcgttggttgaagctcttggaattaatatctagcaagtaccggcgtcgatgtgaaatggtttccacataaccttgttttttcgccgtttggacaatttcatccatatactttttgacacccggatattctttgaagtaagcgtcaataaagctgcgagcctgtttacgcgtaatgccgatattttgtgacaagccgtaatcactaattccatagacgattccaaagttaaccgccttggcttgccgtcgaatatttggcgtcacctcttcagctgagttcaaatgaaagattcgcatggccgttgcggcatgaatatcatcacccgctttaaaagcggcctgcatattttcatcatcagtaatatgcgcgagaacccgtaattcgatttgcgaataatcagacgagaaaatctgccaaccttcatgactaggaacaaaggcttgtcgaatcttacgtccttcttccaagcgcaccggaatgttttgtaagtttggatcaacggacgataaccggccagtttgggtcaacgtttgcaagtagcgcgtatgcactttttgatcagcagaatgaatggcatctaacaaaccgataacgtaggtcgattgaatcttcgagatctgccgatattgtaaaatattagcgacgattggtgcttccggtgctaacttttctagaacgtctacggcggtagaataccctgtcttggtcttcttgattacgggtaatttcatttcttcaaacaagatgtgacctagttgcttaggtgaattaatattgaactcttcaccggcttcttgataaatcgtctgttcaatttcactcaaccgttctgtaaactgactgcccatggctttaagtcgactgctgtcgaccgtaatgccggcgatttccatctgagctaagacattagccatcggtttttcgatatcatcgtaaagttgatcctgctcattggctgccaattcctttaataactgtggcttcaaactagcgattgcggccaatttccgggcgagatgactaaagaagacgtcatcatcttcaggaatggcacgcttaacgcccttaccataaacggtctcgtcactcggcaagtcagtgtacccgtgttgctcagctaaacttcccaagtcgttactgttatcatttgtatctaataagtatgaaacgagtaagagatcaaagtcgactttacctagctgaatacccaaacgattaagcccgaccgtcgtgcgtttcatatcaaaaacgtccttggtaatcgttgtgctactcaagaggtcagccacagtcggttgcattaataattccacatcccgactgatgtaccagtgatcatccgctccgatggcaaagccagcaaaggccgacgtgtggtagtttggcgttggcatctccaagtaaaagtccacgtggtcggtaaattgttgcaattccgtcaggttagctttcgtcaagacggtataatcaatgggcgttgctggttcgtccgactgtaggtgtaatttcttcaaaaatgattgaaagtccatcttctgataaaacgcggccagctggtcaagatccgggccatcataggataaatcagccaattgaacatcaatcggcgcatcccgcttgattgttgctagcaccttagcttgcgccgcttgttcgcgatcctcaatcagatgttccttcatcttgctctgcttcatggcatcgatgttttcataaatgccttccatcgtaccatactgtttgagtaatttaagggcggtcttctcaccaaccttggtgacacccggatagttatccgaggtatcacctgtcaaccccttcatatcaataatttgtgccggtgtgatgcccagcttttcttcaacgtgcgccggcgtatagcgttccacttcagaaacacctttaacggtcacggccaccgtggtatgctcggtcgtcaactgcgtcaaatcacggtcaccagtgacgaccgtcgtggtgtagccggtttgatccgcttgaccggccagtgtaccaataatgtcatcggcttcgtagtcttttaattcataatgtttgataccatatgcgtctaatagctgtttgatatacggcatttgttcagaaaactcactgggcgtcttagcccggccacccttgtaattatcgtacatggctgttcgaaacgtggtcttacccgcatcaaaagccactaacatatccgtgggttcgactgccttgatcatgtggtcaagcattgtgttgaagccataaatggcgttggtatgcaggccgtctggatttacgaaccgttccagttgactatgcaacgcaaagaacgcccgaaatgccacactgttaccatcaatcagtaataatttttttgccattagtttgctccccatctcttaatttaaatcatcatttttatgaaaatccgtcactcagaccattaataccactcgattgacggtctgattcgcagcgcctgtcagtacaggctgaacgactaattatttacccttataattgtaccaaacaattaagtaaaacgggagttcggtccaccgaaaacccgtgaaataactcattttcggtaaattaaaaggattatgacatcttggtcataatccttaataattatcttaatgattagtcgcggcttgagccaccgaagatttggacgaagtagaggaacaagttaacgaagtccaagtataattgtaaggccccagtaacggccaaaccagtcgatgaaacctggtcaccatattgtaaatacatgttgcgcatccggttagcgtcccacatggataagccggcgaagatcaatacaccaatgtatgaaaagatgtaactaatcatggcactttgtaagaacatattgaccagtgaagcgacaaacaacccgattaaagctgcaatcaagtgcgtcccaatacgtgaaatatcacgcttagtcgtcgtcccaatcaccgccatggtcgcaaatacagctccagctgcaacgaacgcaccggtgataacggcacccgtgtataaggacaaggtcactgacatttcaaccccaaagatgatggcaaagagcatcagtaaggtgaagctcatcgctggattgcgtgtcgcgttgacttgaatcccaccaatcatcacaaacatgctgacaatgaagatcatcaagaagatgaatgggtgttgtgaaaaggcggcattaatttgtgcttggaacgtggtcatcgctaagtaaacggtaaaggccgaaactaacacggcgattgtcataaacccatacattttagttaggaaactacggaggccaacttgtgtgttgatggtccgtggttgtgggtcattttgaaaattgttcataaaatccctctttcacctaaaaattgactactcgttactttttccgagttaagattaaaaattgagtttgtgcatcgttactaacgcggactgcgctagtaacaacaccacactagtttgtcaatcatttgcctatgactagccatctcaatcagtcacctcaactttcttaacttaagtctatcaaattagtcaaagaaggtaaaatagtttgtgcctgtgaatttaataagaatttcttatgtctaagtgaattccattcaatcattgtctttaatggattaccgctacattaggattttccggaatgggacaccataagcgtttataatagaacttcaatcggtaggactttttgcgggacatccggggaagattttttaggggcgggcggcgtcatacataactttctaaataagaagtcccacactagtattgacttgctagtgtgggacttcttattatttaatgtacaaagcattgattagttttagcatgttggaaactacaataaaacactaaatctagccattgtcttgttaattgttttctgaagcagaaataccctgcaaatatcgttgtcgcaatgcagctaccttaacctcaacaacttgattatgattaatccgtgcaaaagcttctgtttcactcattaaccgcttaatcaatttatccgaaagttgttgcttaacagcattctcggtcgctaagtatttcaatcttggtaagtaatacgtgacatgttcatctgagcaaagcgctaccccatcatctattagacgattacttgtgacgaaatcaccactaattgcgtaatactctgccgtataaaagattagggttaacagccgtaagtaatcatttgcatatcctgatgagccagcgtgctcgacatagtatcgtactctcctgaaataaaattgagctttctcaggctcagctaaccggccatacatgacacccagaccgacataagctagcggtgtgaaaattgtttggtgagccctatccaaatcatcaacgatttgcgagaaggaaaaacaaatatcactggctgttccattaatcaacgaacttagcatgccacataaatagtaatattgcatccgtgaaggtaccgcatcaatttgctcaactttcaggtctaccaatgattgcaggactgattgataatcttccatcatcagtcgtcgctcaatctcatcaagttgctgtcgaatttgggtcactgaattagcctggttttcacttagatcatcaactgtcaatcccagacgagcgcagagctgatttaaaattgctaatgctggtactcgcccacgccgttcaaacttacttaaagtcgcctgcgtacaaattccgtttgataatttgacttgtgaaatttttaaagcttttcgccgggcaataaacttttcaatatccatcgcacaccaccttgtctcacccgttagccatgaatgccaagggcaaccttagcaaaacgactcattttatcaattccccaagcaggttcccagaccaagtcaagttcacaattcttaacaccatccacactcataattgcttgattaatttgacttgccaataaatttcctaatgggcaccccatcgtcgtcaacgtcatcgttaccgtgcagctaccattatcgtctacgtcaacaccatagatcaaaccaaggttaaccatgtcaacgcccagttctggatcaatcacctgctctaacgacttcatgaccgcgtcttcaacgggtgagagggccttatcctcgccaagttcgtctgccattctgccacactcctgtctgtttaaaactgtttttaattataccattgttagaatatacgttaataatcctaatttataataaagtacgtcgccaatattaacgaaaaggcgaatcagcatgataaaaacactaaccgagatacaattttaaattactacaattatcaaccatcctagctggcacgattataatggctaacattcatcaacaatcatttaaccaaaaaactcgaatcgcaatctcgcatgccactcaagttttattttaacatcagcttaaccaatcccccttactacccgattgaaccttccatctcaaagctgattaaccggtttaattcaacagcatattccatcggtaattgcttcgtaaatggttctacgaatcccatgataatcatttcggttgccttagcttctgaaattcctcggctcatcaagtagtagagctgttcttctgagattttggacaccttagcttcgtgttccatcgcgacgttagcactgtcgatttcattatacggaatcgtgttggaagacgactggtcatccatgatgatcgtgtcacactcaacatgcgctttggaaccgtctgaatgcttggcaaagcgcacggtcccacggtaatcagtcgcaccaccagtcttagcgatggacttcgaaacaatcgaactggaggtattcttagcattatgaatcatccgagcaccagaatcttggtggatgccattgctggcaaccgcgatcgataacatggtcccgcgggcaccttccccattcaaataaacgcttgggtacttcatcgtaaccttcgaacctaaattcccatcgacccattccatcgtggcattttcggccgctgcagctcgcttagtttccaggctataaacattgtcagaccagttttgaatcgttgtataacggcagtaagcgttgggctcaacattgacttcaacaacggccgcgtgcaaactatctgaagaataattaggggccgtacacccttcgacatagtcgacactggcaccatcttccacgataatcaaagtccgctcaaactgacccgagttttcagcatttaaccggaaatatgactgaattggcgtcttcgtctggacacccttaggcacgtaaatgaaggatccacctgaccagaccgccgcgtttaaagccgcaaacttgttatcggttggtttgacgagtttcccaaaccacttcttgaacagttctggataatcgtgaagcgccgtatcggtatcggtaaaaataatacctaacttttcaaaatctttacgcatattgtgataaacgacttcagattcatactgcgccgatgaaccggctaagtatttccgttcagcttcaggcacacctaaccggtcgaacgtccgcttcaagtcagctgggacttctttccagtcacggaactttttatcggtcatcttctgataatacagcatgtccttcaagtcgagtttcgtgagatccgggccaaacttaggcatcggcatctttaaatactcatgataggcatttaaccgataatccaacatccattgtggctcatgttttgccgcggaaatttcgcgcaccgtggcttccgttaatcctcgcccagttgaatatgctggtttgacatcgtcatgaaatccatattcataatcacggtcatttttgaccacgtcaggtacttcactcatacttctgattcctcctcattgccattttcagcaagcaatgcccgttgcaaagcccaccaagctagcgtggcacatttgattcgtgccggaaattgcataatattcgataaaattacggcgtcttctaaggcatccatatcggcctgcgggtgttgcttgccaatcgccatatccgaaaatgtcttagccattgccaatgcctgttctttcgacttacccatcaccgcatccgtcatcatactggccgatgcttgactgatggtacagccctcacccgtaaatccaatatcttcgatttgatcatgcgcatccaattgaatagccaaattgatgacgtcgccacaagttggatttttcaacgtaatggcatgtgttgcgtttggcaacgcatttttatgatgcggatgatcaccatgatctaaaatcacttcgcgatataagccacttaatttagacagtcccatgttcgaaaaactcctttgttgcttggagtgacgttaataattgatcagcgtccgcttgtgtattgtaaatgtaaaaactagcccgtgcagttgctactaagccgagcgctgccatcaggggttgtgcacagtgatgacccgcgcgaacggcgacaccttccatatccaacgcggtagccgcgtcgtgcgggtgcaaaccgtcgatattaaaggcgatgacgcccgtatgatgttggggatgttggagatcttggggaccgtagaccgtgacaccaggcattgcaatcaacttaggcaataagtaattgactaattgctgttcgtgttgctgaacttgatccataccgagttgcgtcaaataatcaaccgccgcgcccaagccgatcgcaccggcaatgttctgagtgcccgcttcaaacttccacggtagttccgcccaggtactgtcatcacggtgaacaaagccaatcatctcaccaccaaattgatacggtggcatcgtagctaataaattctcacgaccatatagaacgccaataccggttggtcctagcattttatgccctgaaaatgcgtaaaaatcaacatcgagtgcctggacatcgaccggcatatgaggggctgcttgcgccccatccgcaatcatcacggcaccgtgttgatgcgccaatcgtgctaacgccttgattggattgaccgttcccaatacattactagcatgggtcactgaaacaatttttgttcgatccgtaatcttgttggcagcatcggccatgtccaattcaccagtcgccgttaactcaatatatttcaaggtggcgtgcttacgcaatgctaactgttgccacggaattaaattactatgatgctccataatggaaatgacgatctcatcacccgcttgaatattggcttcgccataagtactggcaatcagattgagactatccgtcgtccctttggtgaagacgatttcatccgtttttgcagcattgatgaaccgttgcaccttggcgcgcgcagcttcgtattgactagtggcccgctctgctaaggtgtgcacaccgcgatgaacattggcattatcgtgttgataaaagtgaacgagcgcatccacgacttggttggggcgctgcgcagtcgccgcattatccaggtagacaagtcgttcatcattcacttgttggtttagaatgggaaaatctgaccgtaacgtctcaaaattggatgccatcttcaagcttcctttcaatcgtgttcgttaagcgagtccggacagtcttcgatgggatcgcaccaatcacggtacttaagaagccccgaataaccaaccgttgggcctgtggtttatcaatcccgcgactcatcaaatagtacatttgattttgatcaatttgaccaacacttgctgcatgtccagctaacacgtcattttcatcgatcaatagaatcgggttcgcgtcaccatgggcatcatcagacatcatcaaaacccgattttcctgttcagcatgtgcaccggaggccccgtgaataatgtgaccgattccgttaaaaatcaggttagacttttccataatgaccccacgttgtacgatattgccgtcagtcttcttaccacggttagtgacccgcgtattaacacagacatcctgggccttggtcgtcactgtgatgaccttggcatcggatttggcgccttcaccgatcagttccgagtcaaagtccccgaaagtgttaccgttattcatcatcccgatagcccaatcgactttggctccccgactgatcgcggcccgccgattcaaataagcagtcgtgttggccccgagttcatcgaacgctgaaaaatgcacttcactgtcagcccgtgccaaaatttctacaacacagttggcgatattatcgacgtcacccttcgttgtcaggtgctgagttactgcgaaatgactgtcttgttcagccacaatcaagacgtgactaattaacggttgcactcgggtactatcctgaatcgtggtgatctcaattggttctttgacagtaacccctttaggaacatataggaagaccccggcgttcaaaaacgcggtatggtagctggtcaaccggtcctcgtcagttttgacgactttgcccataaaatgtttttcagttagctgtggatgttcgcgaaaagccgtgaacatatcggtcaaaatgacaccctgatcatctagttcatcaggcaaattgacggtcaccgttgtctgcccaacttgtacgatttggatatgaccagcttcggccgttacatcagttgctaaagttcgatccgaacgactgaactttagtggttggtcggtgggcgtcagtggccagtcgcgaatactaaagcgatcagctttgggaaccgctaggccttgcatcgcatctaaagccgctaaacggcgttcaacgagccagtgcggttcaccatgttcgttagcagccgcagctagcgttgttttgatagtttcataatcagcagttgcttccattactgccaccccctaatcttcgtcgtcaacaagtttgacatcaatgttcaaatcgtcacgtaaaccagcataaccttctttttcaagggtctttgctaagtcggcgttaccagtcttcacgattcgaccacccatcatcacgtgaacgacatcgggcacaatgtagtttaacagccgttgataatgcgtgataatcaatgagccgaaattatcgccccgcattgaattaacacccttagaaaccacttgtaacgcatcgatatcaagcccggaatcgatttcgtccaataaggcgaatgatggcttgatcatcaataattgcaaaatttcgttacgcttcttttcaccaccggagaaactttcgtttaggtaacgttccgtcatggattcgctcatattaagtagtgccaagttcttgtcgagttctttaagaaaggccatcactgagatttgatcatcagctggtcgacgtgcgttcattgctgcccgtaaaaattcagcgttggtgaccccttgaatttcagctggatactgcatgccgaggaagagtcccttacgtgcacgttcatcaactggcatgtttacgatactttcgccgttcaacaagatatcaccctgagtaacgtgataagccggttggcccataatagtttgtgataaagtggacttaccagtcccatttggtcccataatggcatgaatttcaccagttttcatagataaattgacgccttttaaaatctcacgagactttttttgctcatcatccgtcacttcaacgtgtaaatctttaacttccaaggttgccatttaaatcatcctccaacaattgaatttattacccaagccgttattccttccgtatataatgattagtcaacgacttcaacaaaaatagcgtaacatcggcctttttgtattctatacttagagtataaccgttttcatttcaaaagaaaataaggcttttccccatattaataaaagccctttcatgctatgatgtaggtataatatttttgatgaattattcactattggaatattcagaaaggactgagccttatgctaagtcaatccgttactaatacatcacaattacatattcaacaattcacaggtttggataatcagaccgttcaacgattgcacagcttagggctacatgtcggcagtccgctggccgttgtccgctactatccgtttcacggaccagtaattgttcagattgatcaacaacggattgggattcggtacaccgtatttcaaacgttgattggaggccattaagatgacgacggttgcattgctcggaaatcccaatactggtaagaccacgctattcaatgaactgacggataaatacgcgtacgtcggtaactggaccggcgtgaccgttgagaagaagatgggccggattcggcactctgaagttgaaatggtcgatttacccggagtctattcacttaatccaatcaccaaagatgaagcagtcgtcaccaactatctgctacataaccaccctgatctaattctgaacgtgaccaacgcgagtcagctcaagcgtaacttactactgtcgatcgaagtgttggaatttggcgcaccggtgattatcgcactcaacatgattgatgacctcaaacggacgggccattattatgattttgacacgctagctgaacaacttggctgtcagatcaaagcgactaacgcccgcaataaagaagggctgcatcagctacgcgaagacttattggcaggttcccatccggccgcgacaccgctcaaactcaactatcctttcatgattgagcaagccattcgtcaggctagccaacagctcatcaaaaaatttgatttgacagcaaacttcgcacggtggctgacgattcaatttattaatcaaaataagccaattcgagcctacgcgaaacacatgggattgacaccactcactagtcaagccgcttattacgacgctcaaaaattcgacgagcagattttccaaacccgactagactttattgagcaaaccttagccagcgctagtcaaaacttggcaagcaccagccacgtcgagatgactgctaaaatcgacaagtgggtcaccaatccgttcttagggctacccgtcttcgtgggaatcttctacttgatgttcaaattatcctttgattgggtcggcacgcccctgtcagatttgttagatagtttcgtctccggaccactatccaccaccgtgagtcactggttgaccatggctggagccatcccggtcttgcgctcactgattgttaacggcctaattgcaggggtcggtggcgtgctcgtctttattccccaaatttttgtcttgtttgcctgtatttcaatcttggaagattcaggttacatggcacgagcagcactagttacggaccgcttgatgcagatgattggactcaacgggaaggcatttatccccctaattattggatttggatgcaacgtcactggtattatggccgcccggacaattgaacaacctaaagaacgcttaattacaacgctgatttccccatttatgagttgctccgcccgtctgccaatctacagcctatttgtggccgcttttttcccgaaaaatcaggccctaattgtcttgtcgatttactttcttggcattgcggtcgccctcggtatggctaaattttatcaactgattttcaacgtcgatgatagttccgtcttcatcgttgagttaccacagtatcatattccccgggctgacattatttggcgtggcacctgggataagggtaaagggttcatcaaaaaggcaggtactatcatttttgccggtacggtcttgatttggttactttcctcattcggcactagcggcttagtcagcgacatcgacaacagctttgccgcgacacttggcaaaacactattaccgctgttcgcgccactcggtgtgactgcttggcaagttatctcagccctctttactgggattctagccaaagaagtcatcagctctagtatgatggtaatgttccacagcgcaaatcaggccggcttgattgccatgatggggcgctttttcacaccgttatccgcatacgcgatgctcgtcttcatcttgctatatgtcccgtgcttcgccacgattgggaccatcaagtccgagactggatcgaccaagtgggctgtttacgccgtctgctcgagtttggtcattgcttacaccttggccttcgtcatttaccaagttggtcaattatttatctgaaaggagtttgattcacatggcattattcgttaatttcttaattatcgcactaattattggggctgctggctatcagatttatcgcgtggtcaaacgtgctaaaaagggcaaatgtgcggcctgcgactatgattgtgaagctaagaaaatgttaaacaaagcccagaagcaacaaaactaagactactgcacctgcctcactaaccacgtggttaatccttagaaatcatacacactaataaaacaccaatgacggagattctagtgaattatcctcattggtgctttatttatcgactgcataagttccattaaaacttgtaaggtcaaaataggtcgcacaactgttgtctagcaataatctaacatctctcatagggtttcatcttggatgctaacgccggtttacgctaaatcaatttaaagacagactaaaaaagcggccctgctggggccgcttttttaaaaattatttcatttggtcttcataaattttttcgtacttttgaatgtcaccagcacccataaagacagcgacggcattgtggtaagccgttaaagcagacatgtcatcggtcgtgataatttcaccaccattgggtaacttagcagctaagtctttggaggaaacatcaccagatttttcacgggcagaactgaagatattggtcaaaaagacgtgatctgccttgcttaagctggctgcaaagccatccatcaatgctttcgtccgtgagaacgtatgtggttggaatacggccaagatttccttatccggatacttttggcgtgcagcatccaatgttgctttaatttctgatggatgatgtgcgtagtcgtcgatcatgaccatatcgccaacttgatgttctgagaaacgtcgtttaaccccactaaagtcgaggagttcccgccgaatttcgtccaagttcaccttttcaaagtaagaaaccgcaatgacagccgtgctgtttaagacattgtgttcaccaaacaatgggatttcaaattcccctaacgattcatcgtgatacttcacttcaaatgaagaccccttagtcgttcgtttgatattaaccgcttgaaagtcgtcacggtcattcgtcccgtaatagtaaattggggtatcaacatcgaggtgtcgtaaactttcatcgtcaccccaagcaaagatgcccttcttcacttgattgccaaattgttggaaagcggattgaacgtcagctaaatccttgtagtaatcaggatggtcaaagtcaacgttcgtcatgatggcataatcgggatggtaagcaacgaagtgccgccgatattcatccgcttcaaaaacgaagaaacgcgcgtcaggggtgcctttaccggtcccatcaccaatcaagtaactggtgggagcgatatgactcaaaacgtgggacaacaaaccagttgtcgacgtcttcccgtgagtcccggccacaccaatactcgtgaagccttccattaattttccaagaaattcatgataacgataaacgggcaaccccatttcacgcgcctttttgatttcaggatggtcatcagtaaatgagttccccgcaatcactgtgaggccttcgcgaatgttatcttcggaaaacggtagcatcttaatgccagctgcagctagacctttttgcgtaaacgtatattgttcaatatctgagccttcaacttggtaacccttgtcatgtaaaatcaaggctagtgagctcatcccagagcccttgatcccaacaaaataataaaccgttgctttatccattatgctaataatctcccatattcacaattcatcaatcatgaggtgaatcgctttatttttaattatgaattggcttgtaatttagttaaatctgctgccgtgaaataaacatctcgtggtttggaacccttagctgctgaaacgtagccgcgactttccaaatcatcaataatattggccgcccgattatagccaatcgagaagtttcgttgcaacttcgatgttgacatggtatcttcatcggcaatgtaagccaatgcttcaggcatcaagtcatcttcattgcgtgctgcttcctcgtgcttcattaggctgtctggctgaaattcatagtgcggtgctgcctgatcacggacaaactgagtgatactgtcaatctcactgtccacgaacgtcccctgcaaccgaatcggtgcgggttgaccgttgccaagatacaacatatcaccgcgtcccaacaggcgttccgccccactcgcgtccagaatcgtccgcgaatcgatctggctggcaaccatgaaggccacccgcgttggaatattattcttgatcaaaccagtgaccacatcaacacttggccgctgggtcgcaactagtaaatgaatccctgccgcacgggctttctgcgtgattcgggcaatgtaatcctggacctcactagaagcaaccatcatcaaatcagctaattcgtcgattacaatcacgatatacggcatttttagagccggctcgtcatgttcgtcggccagtttgttgaattgctcaatgttccgggcaccaccagcggcaagtttatcataccggttgtccatttcatcaacgacccatttcagcgctgccgaagcggctttgggttctgaaatcacgggtgctaataaatgtggaatctcgttgtatggtgctagttctacggccttcggatcaattaacaacaatttaacttgttgtgggttcgctttgtacagaatcgaaaccaggatactattgatgaagactgattttccagaacccgtagcccccgcaatcaaaccgtgcggcatcttccgcaggtcagtgacttgtggttgcccgaataagtcgacaccgagtgcgaccgtcaatggtgacttactgtcgcggaatttatcagaatctaaaacttcggacagcatcaccggccgcgatttcgcatttggaatttcaatcccaatcgtattacggccagggatcggcgcttcaattcgaatatcttttgcagccaaggccaatttcaaatcatcatttaagttggtaatcttgctgaccttgacgccacgagcaggttttacttggaattgagtcacggttgggccaatcgtccaatcgacaacgttggcattgacaccaaatgcgtccagagattcatctaatgcactggccttctgctcgatccaatcatccatctcagattcattggccacgatcggtgctttcaacagattcagcggtggcaaatgataagccgctaattctttatcctcaaggacgggggccgctgaaccgccactatgaactaactcaggttgtgaagccactgcagatgtctctgacaaagcgggactagttgtaactgcagaagtagccgcctgtgacggtgccatagtcacactagtcgcttccccactttcttgtgaagggaccgtggatgatgccacaacgctgactggcgtggccgttgccgacgtcacagcaggacttgtgctagttggccgcatgccaaccggttgataaggttcttcgttaacgtgtgaacgagtctgcgcagtacttgactgtggtgctgcagaagccgccgttgttggctgatccttaaataacgctaagtccgcctgggcatcgtgctcagcggtcataatatcccctaaggatagtcctagcccatgtgctgacttgggtgtcgcactagtcgcagcagattctattttatcatgatcagcagccgcattaacagttgcagcagattcagcaagcgcgggatcagttggttcaaacacttctgtcggccctgccgatactgccaaacttaccgcgctagacgcatttatggcggccgccgacgctgctaaacttgggtcagtgggctcaaatacttccgtggggcctgccgatactgccgagcttaccgcgctaggcgcatttacggcggccgccgacgctgctaagcttgggtcagtgggctcaaatacttccgtggggcctgccgatactgccgaacttaccgcgctaggcgcatttatggcggctgccgacgctgctaaacttgggtcagtgggctcaaatacttccgtgggagccgtcactaccactgaatcatcggttttaggcgtattaattgccgcagccgacacagctaattcaggagtagtaggttcaaacacttccgttggtcgcacaaccatcgccgaagctgcggacaccgtggaatcactgccggtctgtgacgtgttagccacgaccgtttgagcagccacgctcgatgctgcctgactagttactgttgtcgagtcaacacttgaagtcatcttccgttccgcttgactaagaactgccgaatcactcgggtgttcaacttgactcgtgtccgtcccactatcagaaagcggttgttgcaaatcaacagccggtaaatcattagctgctgcatccgcaaacaataagaaggtctcgggccgcttatgcaagctcgcttcaatttctaaataattacggtcatcgtgatcctgaatgataccgccatttgtcagcgccgcactaagctgggctggtacccgggatgggtgaaaagtcccatgggtgccaccgttaaagagggtcgcactagttgcagcactgctactcgaagtagttgcctgactcgtcacctgcttggcgctagtttgactggctggccgttttggcgccgcactaggtgcaccagcagtcgattgtggactagccgatgccgctacaggagttgattgactggccgctgaattattcacttgtggtttgttaaatcgatatttccggaaaaatgccgggccatcataatggttcattttcaatcatcctagtttttaatatctgcaaattaagcggtaaataacgtctgagcgcgtttgaaatcaaatggcgcacccactggctgataatcggcgggcaaaatcaaagcccctggccgttgtggcgcgttcggcaattgtaattctcggcctgaaacaatcatgccatcactctcaacgccccgtaattcgcccggccaaataattaagccactgggcatcattgcaccgaccttggcaacaacaaccaaaatatccgcctgcatattaggtgaaccactcacgatttgaagtggttgatccaaaccaacattcgtcttggtaatctgtaaatgatcagacttcggatgtgcttcggctgattccacatagccgaccacaaacttagggtcagtgtctaaaactaattcaggttcaaaatcattggtttttaataaattatttaattgctcaacttgttcggccgttaagtgaacttgaccattggcatctaagtcgcccaacgtcttggaaacgtcaaagaaattatagcccaaggtttccccactgtcagcatcgctaatacgcgtcacattggcatgtgtttcaatcgtttgggtggccgcatctggtcgtaaaatggtgattaacgtgtcacctaattcggatggattataacttgtaattaacatgtgaaacccctttactctcattttagcgttcaacactatattatagcgtattttacttaaatcatactgattaattatgacttttctttgtattctcgtcaatcattggtatactaaatttaaataaaacatttcctagtcaagttagctgaaaggagacgcaacatcatgaataaacaattacaatatggcggcttgttagcggttgggatggctggtatcgccgggggcttttccgttggcggcctgttcaagcggttgcgccgccccacccctaaccaaattcttagccaagtcaagcgcgcgtttttgaaggaagcaccgattgaaggctcgtggattgaaatgaaaaaatccccattacaaaagttcgcattgcgcacggatgtctactatggcggcattacccgctatgaagatggtcagctggtacagtacgagtttttggccgatgccaatactggtagtattttagacatttaccggctttaataactcacaattgactatccgcatcaaaaatcaaaaatgagcttctggaattaaaattctggaagctcatttttgatgtttccgacaattacactcaattaaaaaacagcgatcgccgacgcgtttcgctgttctcattcagtctattttgctgggaaagttgcaataatcttataaattgggcccgccgcactgaacttctgttcatattcagtctcgacgttatcctcaggtgtggcaactgcatgcaagtctaaccaaacttgttcaaattgcatcccaaagttattcatgctcgttaatgaaaattcgaatagcccccggttatcagtcttaaattcgatctgaccgttgggttttaagacttcccggtaactgctcaaaaacgacttgtaggtcaaacgccgcttttcatgacgcgacttcggccacggatcagagaagttcagatataagcgatcaacttcatggggttcgaaaaaggcagtcaccgcttgaccgtccgcatgtgccaattgcaggttaggcaacggggcctcgactagctttttcaaaataatcgcaatcaccgaggtctgaatttcaatggcaacgtaatttatctcaggatgacgcttagccatttcaatgatgaactggccctttccactccccacttcaatctggagtggctggggtttggcaaaacggctttgccagcggccttttagctgagttggatcttcggtaataagttcgggatgggcggcaattaactttggcgcccacggtttatttctgacacgcatcttgattgactccttcttcatttgcttactcaacaaaatcgccgcgaattccatctgggactcgcggcgattttgttgctcgtcgttacacttcgtactgcgataattcttctaaaaagataatttcatggttcatctgatggtactgattccgataataattatctttgatattcaatagtaaattaatcttagcataccagaccactcgcgtccgtaaggcggtcgtcatagtctcaccgtattcactaagccactgttgccaatcactcaacgggacatattcgcatagtagcatactaatatctgacgccggatccgcaaatcgtgcggaatcccagtcaaccaagtacagttgttggcgatcagatagtaaccagttcttgtggttaagatcaccgtgacaaacgcgataatcagtggccggtaaagtgggtgcggttcctcttaattcatccagaacccgggccattaacggatggtgccgtaaatcatctggtaaatcttgtaagtattgctgaataaagtcttgtgggcggacactctgaccaccgacttttcttaacatccggtgaagcaactcggaattgtgcacacgtgccaataaatgcgccacttcaggcagccgcatttgttgcttcgttaaagtttgaccattcaaccactcttgggctgtcagcgtatccccgctcgagatacgcttcgtccagattaatcgcggggtaatttcttccatcgacagcgccgctaggaacggcgaggcgtttcgctttaagaacaatcgttggtgattttttttgcccatgaaagctttattcgtattcccatagatcgggtaaacgtcccagccatcatcaagttcgaaatccatcagccccactcctctcaaaatttatttaatgactcattattatttgacttaacaatcacattttatagacgaaagttgaatccgtcaagtcctttttaacccttgatacatcaaggttttaagctaatcttaattttaaataccaagtaactaagagatagatttcaatcacgttaatgatgagcaaaatcccaacttgagctaacggtgcgttgcttaaccagaacgcaactaaaaagattaatcccgtcaaacttaacacgtttcgcaataaccgctgaaagtttttcaactgctgtttagttgccagcggataaatgtgcgtaaaaactatattatcgtattgcttgtaaaacggcaacaattgaaacccaatcaagtaaataaataaggcgtccaacgccatcgctaaccaaccgtgcccactaaagtacagtagcaccgcaccaataactgtcaaacgaaccactaacccgctaaattccgtgccgcgcaacatgccacgtgtatataggtagccaaacgcatgctgctgatccttaggtaaccaccgtagtaaccaatccaggtaccgacgacgtttgacactgccttgcaccattggtacatccgtaaataaattaaagaatcgataaatccctaacatacggttggcttcggctttgatgtcgtcacgccaagcaatcaccgtggtcgaccaaattcgttggtgcaaataacgttgtcccaccgcaatcgcgatggccattgcggcactcaaccacggcgtcactaatagtcccactgccaacgtgacgaacgcgccggcccagttcagggggcgcaaccaccgcttcatgcttggcttcacttgatagagatgcgtcacgctcagcgttaactgggcatcctttaacgccaactgggtgatgagtaacgccagcaacgaccagcccgtcatctgatcaacgatcatgagcaacggcacggtcaagccaacaaaaatcacttggactgcttgcgccaaccaccaactgtagcgccacgctttcacgaagtacgcatgcacatcccgttcacgtggtaacaggaaaacggtatcggccggttctaataacgttgcgatatgactgacacttaggcccgcccataataagagaccgaacacccagacgatccacgtctgctgagggccaagcgtcttgagccaattggaataagccagcccgagtccgccgacaaaaaacattaatgcaatgacaaagtgatcattgaacaccaatcttaggtagcgcaacatccgacgcagatgccgctgcaaccgcgtttgaaataactcattcatcacgggtcaccccggtcaatgaaagataaatatcgtttaacgactcacccgcatccggataattcgctttgatttcagcaaaagtcccctgtgtctgtacttcaccagcatgcaataatacaaacttatcacaagctttttcagccgtgtccaaaacgtgcgtcgacataaggacagcggctccctgtgctttgactgtcgcaatcaatgccaacaagtcgtgcaccgccaaaggatccagtcctaagaaaggctcatcaataatgaacaacttagcgttagtgatgaacgcacaaacaatcatgactttctgtttcattccctttgagaagttcgcggggaaccaatccaacttgttagccaatcggaaagttttcaataagtcatgagcccgttgccaagcctgttcttggtctaaaccatacgccagcatcgtcatttctagatgttcttttaatgttaactcttcatataagataggtgtttctggaatgtacgcaatttggcttttatagctttgaggatcttgtgctaatgtcacgccattgagcgcaattgatcctttcatgggcgtcaacaaaccgataatatgattaatggtcgttgacttaccggccccgttaagtccgatcaagcccactaattcaccgggctcaacttgaaaactaatatcttttaagacgggaatttgcgaatacccaccaactaagtgttgtaccgccaatgtcataacgttaacctctttctgtgttggtataagtgctcccattatagcatagccatcacgacaccctctatttggttggctcattgatccccgactttaccgaaacttcagtaatttgtcgtcaatcaagctacctagttttgattgccgcaacatcgatagtgtataatgaacccaactaaataaataaagaaggttatcacatgacagcttttgaaccaaaactcgatgacgattgtatcttttgtaaaataattaagggcgatattccgagctataccgtttatgaagacgacatggtcaaagcctttcttgacatctcgcaaggtactcctggtcacactttagtcgtaccgaagacgcacgttgccgatattttcggttacgatcgtgatcttgccagcatcgtgtttgcgcggattcctgaaatcgcccgcgctatcaaagcaactgacgagaatatcattggcatgaatatcgttaacaataatggtgcggtcgcttatcagtccgtcttccactcccattttcacctcatcccccgctacagcgataaagatgattttcggatgatctttaaggacaacgccaaaaaatatgacgaaaccgactacactcgcttacagaacgccattaaaactgaattagctaattaggaggtctcccatggcaaagtttattcgtaacagcctgatcggtctgggtctcagtgctgctacctacatgttgatcaatcagaaaacacctaaagcgctctacacagacatcaaaagttacgtgcaagacgttttagatgctgctgataacttacaagacgcacgtgaagagtttagcgatgcccagagcaatctcagtgttcaaatggcccacgctgcggaagtttttgatgacattcagactgaattggataaatttcaatttaagattgaaccccacgtagccatcatgaaaaaacgtgcggatcacttacaagacaccttagaccatttaaccaagacaaccgactaagcaagtaatcgtgaggtcgcattaggcccacgattcttttgtttgctatcttaacaagctgatttcgtttaaattcactgacgcattaggtagaatttatgaagaggctgtgaaatctctgaaaattttgtaaagatttccatatgcatgcagaagctttaatagatatggtatagtagtcgttgaagtctgctaacgcagaacgatttcaagaataggatgtgttttaggaatgaagaaatggctcattgcccttgctggtgtcttactaaccttcaccttagctggttgtggtagcaagaccgttgcatcaacttccggtggtaagattaccgaaagccaatattacagtagtatgaagggaacctcttcaggtaagcaagtcttgcaacaaatgatcctgaataaggtgctcgaaaaggattacggctcaaaagtttcgactaagcaagtgacgaagcaatataatacttacaagtcacaatatggtagttctttctcaaccgtcttatcgcaaaatggtttgacgaccaagaccttcaaggaacaattacgttctaacttattattgaaggaagccgttaaagacaaggtcaagattactgataaagctttgaagaagcaatggaagtcttacgaacctaaagtcacggttcaacatatcctagttgccaaatcagcaactgctgacaaagtcttagacgctttgaagaaggattctagccaagccaactttacgaagttagccaagaagtattcaactgatacaacgactaagaatgatggtggtaagttatcagcctttgataacactaacacgagctactcatctaaattcttaacggctgctttcaagctgaagaacggtgaatacacgacttccgctgttaagaccagcaacggttatgaaatcatccggatgatcaagaaccctggtaagggtaagatgtctgatcacaccgctgatttgaagaaacaaatttgggacaatgatatgagcgactccactgtcttacaaaacgttgtttctaaagtgcttaagggtgggaacgtttcaatcaaggataacgatttgaaggatatcttatcgtcatacctttcaacctcatcttcatcaagctctaactaattaaattaattaagccaccctgacgtttaacatgtcagggtggctttttttgcgtcgtactaagtctagcgcgtcaagcatgaattattattgcgctagaaatatacgtctctatttagcagatcaatcagctgacaagttaattatgattaatcatttcacgcacacttcgctagtcagtctaattattcaaagtcatcaataaaaatttatgattttattatcccctatcgccagcattggcgcaaatatcagtgctatcacaataaattcagaaccccctcggaacataataagctaagactaattgctaatcattaaatatatgcataaaaatagccgcaacctaatagattatgctagccttatagcaacgataaacgcaagacaatcttctggccaggagttgattatcgttaccaaacatttgttgatcaccgcaggcacggacaaccaaaaaggagcgatccatcatgaaaaaaacagtgcttaccgcgaccatgttgttaagcttactaggaatgcccgccgtcatggcaaccgccgattcaactgcgaacacaactactaatttggaattgacagaaaatactggaccaactatcccagtagatcccactaacccggccaatccacaagttccagaagatccagacaatccagctactggtaatactggtgctctaacattagacgtggctcctcgaactttcgacttcggctccgttcaaacttatgccgccgaacacacttataaggccacgacgaccactaatgggcaacaatatttacaggtcaccgataaccgtgggaccgatgaacagggttggaccgtaaccgtcgagcaagatcaagatttaaccgaaactagtggaagttcaccgcatgttttgaccggtaccaccatccacgtaccagccgggattgcacgtaatagtctggcaactgaccctacggcggtcgataccaacctgacgactacagctgccgatgttaccaatacgagtggtgccgtgaccgtttttaatacaacggccactaccggcgctggtaaaggcacttcggttaaagtttgggatccaagtgatgtcactttgacgattcccaaaaacacggccaaaccaggagcctacagcaacactttgacatggaccttgaccgctgctacccctagctaaccataaggagggattgccatgtttaaccgcttttgtcttagtacggggttagcgattttagggttaatggcaaccagtttgacggctctcggggcaacgactaatggtaccgtgacttttcaagatgatactagtgccacggccccagttgatcccactagtcccaacgtcccgttgacaaccaccgatccgaataatccggcaactaacaataccggaacattgaccctcgatgtagccccaaaaactatcgactttggtaccgtcactacgtccaacgcagccaaaacttacactgcaattggcaactacaatcaatatctacaagtctcggacaaacgcaacactgccaacggctggcaagtcaacgttaagcaagaccggacgttaactaacgctagtaataatcacgtgctgactggtgcggtgattcacctaccccaaggaactgcgcgtaattcgctaaacgagcccgcctcagtagccgattccaatttagttgttgcccccagtgtaagcgtcaccaccgctgaccaagtcgttttcagtgcccccaaccgggcgggtgttggtaaagccacttccacaaacacttggaacgcgggtgccgtgaccctttcaatccccaagctgacagcccaagtcggtaactacacgaacaacttagtttggacgttagtcgccgctaccactaactaggaggtaatcatgaaaaaattgatgtgcttattcggcgtaattggtggcttggttttcatgagttggacctcaccaagcgtccaggccaccgctaccaatgccgaagttcaatatagtgttaacaaaatcagtcccggccaagaagtcgatgctagcagtccgtttttcgaccttaaggccaaggcgggcaccactcgtaaaattcaggcgcgggtctataacccgactgaccaatcaattacggtcaagacccagctactcacgacatttacgaatgattcaggccaaatcgcttacacccaaacagccaaacgatacgatgccagcttaaaatatcgttttgatcaaattgcgactttggcagccggttccgataaagtcacggtccccgccaaaagtaaccgggtcgtcagcgccacaatcaacattcccaaaggattcgataccggtgtaatcttaggctcatggtacttcgaaaaaatggggcaaggcgcgaaaaaagcatccaagggcgtcaatattaaccaaaaatatagttatgcgttagcggttaaactgacggccaaagaaattgcacagcctaagttgactttggggacggtcactcccggattacgcaactatcgcaaagtcgtgctcgcgaccattcggaacccagaaccagcagtggtctcgcaattaaaactgaccactaaggtcacgagaaaaggcagttccaaggtactctatcagaacagtagcgacaacttgatcatggcccccaattcgaacttcacttaccccacttttttagacgatcaagtcatgcgggcgggtgattataccttatccgtcaccgcaacgactaacgactccaaatgggccaaaaaaacttggcattggtcccgggactttaagattacgactgaacaagcacgtcaaaataatcaaaaagccaagaatgacccggccgcccccatcagtatctggtggtacgtcctaatcgtcattgtaattgctggcttatccgccggaatcgtttatctaattatgaaacgacacaatcgcagaacctaaataagcagttaattttagattatcttctaacttggtactcaaacaaggaggttatcgttatggctaaattcaggcggctagttttactatcattaagccttggactagccctcgctggtggctgtcggagtcccgatgccctagcggctaccccaactgacactagtgtgacattgaccgactggcaagccgggacggacctgacaaacttccagcacccccgtccctatcaatatctagcggtgcccaacatcatcgctactgctaatcaacaggcttcgactcagacaccatcatccgcggcaatacgtccagataaatcagtgctaccacaaacgaatgaagcccgccaactgttagtctggttaggtctgttgacagctgtcttagccggttggctcgtgtggctcatgcaacgccgaagggagtgagcaatttgcaacgaccacgaagattaataacggcttggctcgggttactcgttctcttaatgagtctactcgttgtcaacggcggtgccatttatgcgacagcgaccaccacggccacaccaatcaaattcgaggaaccacccacggaattagtgattgggcaaccttttacacttcagttggccgtacaaggttcccaggaacaccaagtcatggtcgctattcctgaggccctcaccgttgaccaaactaaaacccggcaagccaacagagcgagcctcgctgagctggattttgatgctgacaaccggaaactaactttgacgccatctgatccgacagccagtaccacgttcgatttggtattgagtgccagtgaagcgaaaacctacaaagtgaccgcggaagcactgattactgggccagcattagcgaccactaccgcttcagctgtcgccagtagtgaaaaaccgacgacccacaccatgaccgctgaaccaataactttcaccgtggccgcgggctccgcagtcgactcacctcctgaagaagccggcactgaatcagcacgtgaggtcagcaatgatgccgaaagcacctcttcggccagtcaagacccgaccactgacgattcgtcagcaacagcaacacaagcggctaccacgaaacgtgatgacaacaatgccacaagcaaatcgtccgaacagtcgtctagtaccaccgcgacatcggacccgactgctgacaacgacactgctactagtcgcacagcgcaggctgattcggaagtagaacggacaccgaaagcgactgccaccaaagccgctaatgatatcacgaccgccgcaatcgtggtcaatccagatggtagcacgaccgtctcaacttacgatgatttaaaatcagcgtataccaataccgccgtcacgacgattaaattgggggccaacattacccacacgtcaacaagtgctacagaattaggcactcgtaccaccagcctgaccatcgacgggcaaaatcacagccttgatctcggcatcggtaacttcacattgggttccacaaccacggcccagacaatgacagtaaaaaacttcagtagtattcgtggcgcaattgcgagtggaacaagtagtggtggcgccgccggaatcattcaaagtgggaccgatggtggggctaatgctggtggagctcgttggacgattacagtgaccgatttaatcactaccagcgacgtttaccgcctcgtcaacgctcctggtaatcaagtcaatgtcagtggcgcagtcaccgcaacaaccgtcgctgaaaacatgattactggtggaatgacctttgccgccagcagtacctacatcggtcgcaaggcgaataacagtgccgccaacaaagctttcttcaacttcacggcaactagtacagttgggactggagaccgtaaagtcactattggtagcgctgctaatgttaacttgctaggtagcgcatcagacgcgactcggggtattttctatgaccagtatgatgccgtcacggtggataccaacgctatcctaaccgccaagatgtacggtaacgtctatcgggcagaaacagcaaacacgtttaccgccaacgttggcagtaaggtcacgtttgagaacttagccacaactagtagtaatgcgctctactacactaccccgttgattccgcttggcaacaacagtacgtttaccgtgacgggtggtgagttgtatatcactagtagtggctcagcccccatttttggtggctacatgtccggtttgagcgtcttgctagattctcctaaggcctacgacattaaaaatacgaactttgcaattctcgttcaaacggggtcaatcgtcgagacgaccattaaaagtttcaaaatcacgaacagtaacctgagtatgtggtcattgtccttattgaacctgttgagcgccagtgtgacctatcaagggatcaccgccatcgaacagaacggggtcctgattaccaacagcggtagcgtcttaccgggactactcaccttctcggctgcgcgccgaattgcgaacaccctctcattaccgactgtgcaattcagctcaccgtatacgagtgactttaacgcccagctcgtcaccaatgccgacaagaaggtccgcgttcgcgttatcaccggttatacagaatcgaatggcacacaaacgccgatttacgccggaacgggcacggcaaccgtcaagttaacagatgatcaaggcgcaacgcaaagtggtacgactgacagcagcggttacgttaatttcacgttagatcattttccaacggccggcgcgactatgacagctcaagcaacgaccacctatacttcagatcctgtcaccataaccgtccaggataagacgccaccgacgccggtaaccgttaaagatggaaaaatcgttgccgaccaaaaaacgattgccagcggttccacgacgacggctggtaacacacttcgttacacggttaacgggacctccgcagctgatagcaacggcaatgccatcaccgcaaccgctgccagtgatgggagttggtcccttgcaatgccagccaccaaattaaaagctaatgacgtcattcagatttttgtgaaagatagtgcggggaacgagaatccggtcaccagtacaacttatcatgatgccacgtttgccgccgctacccaatacactgtcgcaccggcaatcggcccgacagcaccaactgagcccgagcaccctggtacgaccaataccagtgggagcgaaaacactgggaccggtaatacgggcgaacttcgtttagactacgcgcccagccaatttaactttggcagtgtcacaacaagtatgcagcctaaaacttacgccgcccagacaatcaacggtgtcgcgaaacagtggctccaagtttcggataatcggttagcaactcacggttggaccgtcaccgcccgccagaacagtccttttactagtactagtggcgcccaactcaccggcgcgaagttacacattcctgccgggcagacctataatgaacgcgctacgggccagctcaaaagctacgcggtcgatctcacaaccgccgaacaacccgtctttgcagccccagcaacggccaacgtggggaaagacctttcaaccaacgtctggcaacccacccaagttcaattgaccgttcctggcaacaccgcccaagcgggccaaacctataacacaaccgtaacttggacgctaacggctaacgtgacgaactaacaattaaatgtgccaaactgaggctcctcggccgtacaccttaagtactggccccaactctagcaattggaagcgcgacttcaaagcaccattagaccaccacaataattgtcgatttcatcacttaaatttgaccgtcgctggattgcccatcattattgatgacgcgacggttttttcctgtgagttcctaatgagctaatcatcagtaaccactagttttccatgtcatatactgagcttaagcaacacatcaacttaaaattgccaagtccgtataatgggcttggcaataatcaacctagttagtggctaaagtttgtaacgcctgtaaactagccgtactgagtacatccaccggctggcttaatcccggttgaaagaaaaagtcaccataggctaattgctcgagcgttgctcccatctggattgcgagcgaaacggtattgatgaccgccgttaattctgctgtagacattatttgtgcacctagtatccgatgagttttatcataaaacaacttaaaatgaacggtcgcattcaatcgagctggtgcggatgccaccaatcggggaaccgcgatgtaagttgctaacaccggttgttgcatacggacagctagttgcgtgtttaggcccgtagcagcaaagtaatatcccgccgcattaagcgcggacgttgcctgaacgccgggaaacacaattcgctgatccgttaacaagttatgcgctaataaccgaccggcatgactggccgcgctgcctaaagtgatccgctctttagtacccgtgggcgtaaaccgaactttagtcgcatcgccaatcgcgtaaatatctggaacacttgtttgaaaataatcatccgtctcaattaatccctcagaatctagcgccaaagttccccgtagccatgcagtattcggtcgattgccgactgcgacaaggactaagtcggcagcatactgaccacgattcgtttgtaccgctgtcacgtgtgttgaacctaatacggccgtcacccgctcttccatctttaattgcagcccattctcaacactcgctgcagctaaaatttgcgtaaattctgaatcaagattgtgactgaatggccgagcgttcacatcaataacagttacttgcttgccggtttgtttaaataaggctgcaaaattcatcccaatatagccgcctccaatcacgaccacgtttttaatggctgctgacttagcggccaattttaactcattgatgctggcacggttttgaatcgatcgaacaccagataattcggctccgggaatcggtaactggattggtaacgatccaacgctcaataccaatcgatcgtaatgatcagtctgtaattgcccccgttgattacgagcagtaatcgtgtgggtcgctggggtaattcttgtgaccgtcgtttggtcgaatagagtcacctgctgggacaaggccaaccgctctttttcagcatccgccggagcccaatccaaagccgtcgcgaattgcccgtgctcgtaccaatgaatctcattatccgtattagctgctaataagccattgaccgtttcgcggccgccatgtgcagccccgacaataataatttttgccatattttccgcctctgattacttaaattattgttaacaacgctatttaagatacacgttgtctttaactacaacaatcgtttggctacggaaatcactattattaaggcacaaaaagcagtaaactgtttctaaaaccaattaggagatctttttgtgacccaactcaatcaacgtcgacgtggcaaccgactggaaaacgcgatttatgacaccacctataccctgcttagtcaatacggcctcgaccaggtcactttttcacgagtagccactgcggccgctaccagccgcagtgttctttatcgctactgggattcgacctttgacctcatctttcatactattattcatcaaatacaaaagactcccattgcacttacgaccacgccattagatactggcagtcttcgtaccgatctcattctgttagcgcaacgctttatccaacaaactagtacggggcccttccgctattttcggctattgtttgccacagccttgaacgcgcagaaccagcgcgatctcacgcagttagtgactcaaattgatcatgccaacttgaccttgatcgagccacttctgacgaatgcacaaaaccacggtgaacttcagatttggcctaaccaagccgcacaattagtattgtttcaacaattacggtactgcgacatcatcaaccaaccgatgaacactgatcagcaactcaccaatctcattgatcaagtcgttttgccggcattgcgagcaagtggcgttgctaaccggcattttcatcattaaagaacctcttcctcacaagtcaaataaagtctgatttcctagcccatactgcgttggaaatcagactttatttttaatattgaaccagcgtcacccttaactagccaaaaccaggcgacgcccccctttacccgtctaacaaattgtaatctggcgcttattgacgataatctgcccttcagccgccaattgtttaaactgacgactcagggtttcgggagtaatccccaaaatattcgccaattccttcttcttcaacggcaattcaaattcgatttgtccggattcaacggcacaatcgcgcaaatacgccatcaaacgcgctttagcatccagcaaatctcgtcgcaattgattcttctcagcttcaatcaattggttcccaaaattattgatcattgctaatgataaactggctgattcacctaataatcgctgaaaatcatcatattgaatggaacagacccacgcatcactcgtggcttgaataaatccctgattctcatgcggtgcaaatagccagtgttgtccgacgacatcaccactacgcaacaactcaataattttctccttaccattagcagctaaggcataaattttagccattccctcatctaaaatgagcatgccttcctgatggtcgagtggctgacgaatcaactgccctttttgataaaatttccggtgatgggtcaccgtgattaatttggctttcaccgctggcgctagcggtgaaaataatggtgaacgactcacacaatccatttttgaatgcataatttctccttttcttgatctatgtcaatttttatatgattagactagcatatactgaccatataatgaagaactggaggaattattcatgactaaaaaatacgttgctaacatcgtcccgctgaacgccgaaggaatcggtactgccccacacggcacagcgactttcactgaaactggtaaccaattacacgtcaccattgaaatgttcgataccccggccaacacgcaacactgggaacatttccacggctttccagatggcaaagcggcacagattgctactatggcccaagatgtcaatcacgacggctttgtagacttgcctgaaactgaacctgtttctgggacgacgatggtcccatttgataatgcgccccatcatatggacgtaccaaatgataattacccagttgccgacgcgcagggccacttcgcttatgaaatcgatgtgcccttaggcgacctacaggctaagttcaaagaagtcttcggtaccgatgacttagaactagacaagcgggtcatttatattcacggcgtcccacaagacttagccctacctgcatcagtcgctggtgaagtgggcatgtatgatgctcacgtaaccctaccaattgcagttggtaagattgaggttacggaagactaggcaattattacttaaactcacaaccaaaaactaagaccgcttaccactatcagttagtagtggtaagcggccttaattttttatgaaatcagcaaaagcaaatcctttatttgaattgcacgatatcattactatgttagactatttttaaccaacattaaattgaggtgttttcaatgaccaacgaacaacgagttattcatattattaaaacaactcctgctttaatgacgattcttcaattaattcaagactgtcatttaaaacaaggcgcattggcggctggtagcatccgtaatactgtttggcaagtactcagcgggcagccagtgatgttcaacagtgatattgacgtcgtcttttttgaccctgagcgaccagccagcgatgatttaaaaatctatcagcaacttactgataaagccccacaataccaatggcaaataaaaaatgaggtctatatggcacattataattttgataaggatcccgaattcacttccgttaccgatgcaattggtcactttgtcgaagttccaacttgtattggcgcctttttagacgaaaatcaaatcaagctaatcgccccatacggtgtagacgatttgataaactttcgctgttccccaatcccctactatcgccaggatgccaagcacatggcaatctatcagcagcgaatggcacagaagcagtggcatcaacaatggcccaagttacaaattgatggtatttgaaatattatgcatacccttaatttacgtcatttaggccaagtcagcttttaatattgcccgctgcacgtccaacgtttctaacaaactgaccgcacagtcagcacccttattgccactcttaaagccagcgcgatccatagcttgttcaatggtatccgtggttaaaacgccgaacattatgggcgtatcggttgccaaactgacggtcgcaatccccgtcgtcacgccacgacaaacatagtcaaagtgcgcggttgcaccccgaatgactgccccaagtgcaatcacgccatcatagcgcttggttgtaatcattttttgaaccgtcagtggaatctcaaaagctcccggtacccaggccacgtcaatatcggtttcattgaccccatgctgtaccaaactttcttgtgccccagttaaaagctgctgcgttacaaacgcattgaaacgcgccacgacaatcccaatcttaagcccgttgccattaattttgccgttaaaagttgtcattcgtgtccctccgttagtgtgagttgatgatgaaatcgatcacgttttgtttttaagtaagcttgatcgtactgattggctggtatttctaaggggacccgttcaacaacatcaatccccgctgcacgtaactgctcaaccttgtcaagattattagtcagcaaacgaacccgtgtaatccccatttggcgtagaattaatgccgcaatatcataccggcgctcatccggttgaaagcccaactgcacgttcgcatcatacgtatcaaccccgtgttcttgaagtgcgtaagctgctagtttgttagccaagccaatgccgcgaccctcttgccgtaaatagacgaaaacaccgcgctgagcttgactgatcttttggagtgcggcgtgtaattgatcaccacagtcacaccgccgcgatcctaaaacatcgcccgtaaagcattcagagtgtaaccgcactaacactggttcatcgccactgatatcaccagcttgcagtgccactggcaacgccgtatgaccgggggcttcgaaaccagtcatcgtgaacttaccatccttggtcggtaagttgacactcggggtcgttgtcagctgggcggcacccgtttgaatcacgtaggtggtaatatcttcaatggtgattagcggtaattgtaagccctctgccaaagctttgagatcacggcgccgcgccattaagccatttttcttgataacttcacaaatataggccgcgggggtcacacctgctaattgtgctaacgtgacggccgcttcagtatgaccacgccgcgctaacaatccaccagtccgcgcaatcaatggaaaaacgtgcccgggatgatagaaatcagcggcctgactattgggattggctaacgcttgaatcgtggtcgcccgatcagctgccgagattcccgtggacgtcgtatggtgatccgttgagactgtaaatgccgttccaaacgcatcgtgttcactagtcatcggtgtcaaatgtagtcgcgtggcgatacttggcgccatcggaacacagagtagcccccgcgctgatgtaatcatccgattcactgtcgcagtggttgctttagcggctaggccaaccatgtctccttccgcttcacgcgtctcatcatccgcaacaataatcaattcgccccgttttaatgcggccaaggccgctgctacctttttcattgtatccatcttaatgactcccctctaatgctaattgccgggccaagtacttgcccagaatatccgtttctacattcaccagcgttccaacttgtaacttagacaaggtcgtcaccgcttgtgaatgcggaattaaatcgacttcaaacgttgtctccgtgaccgctacgaccgtcaaactaaccccatcaactgccaccgagcctttagtgactactagtgcgcgatattctgacggtaaactgatcaacagacgcaacgcgtgcgcatcagattgtcgctgcatcacttgaccacagtaatcgatgtgcccctgaacaatgtgcccatctaagtgcgcgttcacttgtaacgcacgttctaggttcaccaatgaaccgaccacaaggatctttaagttcgttcgacgcaccgtttcaggcatcaccactacactgaaagcatccgcttgtcgggtcgttaccgttaaacaaatgccgttcaccgctatactgtcaccaatcttaagactcggtgtcatcagcgacggtgcggtaatcgtaagggtcatttccaacccttgttggtgcacttggctgacacggcccttggtttgaataattccagaaaacatttacttaacttcctttcgaacggcccgtagccggatattcgtccctaaacaagttaccgttggttgttcaaatgtcaacggtgtcatcgcagcggccccggtaacggctggcaaacccgtcccaccaatcatcattggtgcgatgtagctgacccattcgtcaatcaattcagccgcaacaaattcagcttgcagatgagccccaccttcaactaagagtgactgccagccttgttcgacacatagttgactgattgcagcgggtgtccagttgccaatcaggacgtgtacattgggactgtttcgaagttggtcgtcactagccgcagcctgacgacaaagtaaccaggttggtgcctgaccgtcctgaacaagccggtggtttaacgccacggtactcgtattcaacaccaccaatcgaaccggtggctgcaccattgccgtcagtcggacggttaattgtggatcatcaatcgttagcgtccgttcaccaatcagaatcgcttgaaactgtgaccgtaagcactgactatcgatataactagcatgattggaaaccagcgtccgagtcggcgtttcagtattaattttgccatcaagcgttatcgccgtttttagggtgatccatggtcgctgctgcacataaaaatgattgtagtgggggttcaacgcgcgaactttgtccgttaaacagcccgtcaccacatcaactccgtggttcaaaagatactgacgtcccttaccacccacgattggatggggatctaattgaccaatcacgacttgccgaattccagccgcgacgattcgcgcactacacggcggcgtcttcccatagtgtgaacaaggttccagtgtgacaaataacgtggccccacgcgcctgttctggtgtgacctgccgcagcacatccacctcagcatggtcaccgccaaaataatgatgataaccttgagctaacacgtggccgtctttgactaataccgcaccgacctggggattttggtacgtcgccacccccgccaatttggcttgatcgatagccatttgcataaaatcagttaacattggttcacctccaacaagataaaaaaacacccaattatcaaatcatcgataatcgggtgtgaagtgttcgccaaatagatttcaccagtaggatccagctaaataaacctacttaaaggttgccaatagccactactgcctagtaaaattcaagcaataattttcttctcccatccagactatactgtcggtcccagacttgcactgggtccaccgctcacgcgggtcacggacttcaacttacgttgttaccgtcggtcgggaattgcaccctgccccgaagaaatcgtattcagttttcaccttttataaaaacactttcttaatcaattgtcaatcaccccttttagtttaacctcgtgaactgctgtgttaaactgctagcaaactttataaaaatgataatgactaacactaattcttaacttttttcagaaaattgttcgcttttcttaactagttttcaagtttcagtacggtacaatgaaatcattcataatatcggagttgaataaaatgtggcctaattatcaaacaagccgctggcaagtggcagtgacagctggattactgtcccttgctatcatggggattgtcttcgcaatttgggggatcacgcccttcggtaaccataacttattaattagtgatatgggtggccaatacttatcatttttcaccgcgtatcggcatgccattttaacgcatagttttcaattatattcattttcacagtcattaggcggtaacgcactacccacgattgcttactatctattaagcccatttaacattttgatgttgttgtttccggcggccaatttgccaaccggacttagtctactcatcatgttaaaaatcagcttgattgcggtcactatgacggcttttttacaaacgcattttcaaacaaagcggtggtcgactgccatttttggtgttgctttcagcctctctggcttcgttgccctcaactattttacgatcatgtggttggatacattaatttggttaccactggtcattcaaggactcgaccacttaattgcaactagtcatcccgggcgctttttcggctggttatgggtcagtatcgtcaccaattactacttaggctatatgacttgcctatttgtgatttactattttatttatcaactatttgaacgcaaacgccctcaggacagtctttggcaaactgttcgtcatcaattttcgttaattcggcacgtcgtggtcaccatgctactcagtgggttaagcacgatgtttgtcctgatccccactggtttaggcatgctgaccacggctaaatctgcggtcaaattatcgagctacttaccggtcccacaattcggtttagctgttttgagtcaatttggcttaggtgccgccaattttacgactcggctcgtacacgcaccaaccgtcttcagcagtagtctggtcgtcttgctggccctaagtttctgggtgcagcccaacttgactaaagctcacaaatggcatagcttcggactattacttgcactcttcttgagtatggacattcgtaccttagatacgatttggcacatgtttcaaacgcccgctggctttccataccgcaatgcttttttctttagctttgtcttgatcatgatcgcttttgaagcctggttagcaggcccccggcggatcgccttgcgctggcaatggttgttaccgacactcatggtcagtgcgctgatattaggctggtttgcccaacgaactgctaagcaccccttaacaacttcaacgctggcgctcagcttagtcgctgtcatcttaaccgcaattgccttattcgcaacggcgaagcggtggcaaacgctcagcttggcaggtatcgtcgccttagaattagggactaacagtaccctcatgatggcgaagtcaccactagggaatcaggctaaatttgtaactgcctatcgaaccgaataccgccaaatgcaagccgtcaacgatcctgatggtcaattatatcgcgttgaaaatcaaaatacgctaatcaatcaggcctacaattatgatagcaagtatcgtaattacaacgacccgatgttatttaactttcacgatattacctactacagttcaacttttgcgaaccaaacacgtctcatgttgaagtcacttgggctattttctaaaaacgcccggcgtgtcagttcagaaggcctaaatccggtcactgatttactcttagatgtaaaatacgctgtgcaattaaacgccgtgggtcaagcgacaacgcggctccgtagtcaaaacgggttagggtttgccgtgccaatagcatttagacagttaaagcttcgtcagaatagtgccattatcaatcaagaacgcctcttacaaagtttgcggccatcgaaacgcgcctattttggcaatgccacgacgctctcagatcacgtcgtccaagattcacaggccaaacgctatccgtatttgcatacagttaaattaaggatgacacgcaccgggacgctgtattataacgacacgactcgtcaaacaaagtacaccacgatgcgggtcaacggtcacttagtcccgactaagttcaatgccaacggtgagttagtgctccgatcgctaggttattttgacaaaggcgctgtcatcacgttaacggtcaaacgtacccaaccaacgcttggcacccatgtccacatcgccagcctggatcaagcccggttcaaccaagtcaaacagcaactgctatccacgcgctttacaccgacttaccacgtctcgggcattcataccgtggtcagtggtcaagtcaccaatcgctccaaacaaaaatggctctacgttgctattccagccgataaggggtggcgcgcaacggtcaacggcgtcaaagttactcctaaaacggtcattggcgggatgttagccctgccgattcagtccggtaagaatcagatccagctaacttaccacgtcccgggattgctgggtggactactgatctcaatcataagtggatttagcttcatcctttggcgtcaacgatatcgccaccattagaatcgtgtcaatcaaaacaatcggactgccaagctattctgctaggcagtccgattgttgttttaatggtcgcggtaactgctagaccagtcgcgttaatattggttttagatagggcacaattcttatattagtcaaaatcaattcaggtttcatccaaagaaaggccatatgttcagtaagatctaagttgactgtcggtctagtaacgaatgcctgtgcgctatacactaaacgcgtgtacacctgatttttagccttgtcaaaggtggaatcttcccaaataacgcgctcagtttgaactttcagcccagtctcttcccaacattcgcgtttggccgctacttgcggtaattcattagctaatgcacacccaccgggcagatcccaatagctggcatcaacattcggccgcccatgctcaacctgattgcgttttaaaattaaaatgtcgtgcccggcagtcactaaagtatgcgcaataatttgaaccatttgaattcacctcaccttgataagtcacccaaattaacggctattatatttcgtttaaccacaaacaaaagtcccaacactggcaacaccagttattaagactttcgattcaagttttattattcagtttctggccgtaaccgacctaacgataaaatggtcgccagcgccacacagccgacaactgctagactggcggcacccgtcgttaacgcgtgcggcttaataaactgctgttttatcacgacttgtaagtatgcgtgctgcttagccgtcacccggcctgttaacggactgtagttggccgccatcacaccataccggacgggcgtctgaccagtatttttaatcgctaatcgcaggttgcccgccgctgtcaacggataattcaaagtggtcaactcattggccgagccccgccaccgtttgacgacatgcgcccccctagtcaaggtaattgttacgcgctcatgcgtcgcaactggcttcaaccgtaaaacattactcttaccactaacggctagcggcgacgtaacagcgtgacccggtctaattttttgaaccgtggacacaacataacgcccattgccctgattgccacgtaccacatcagtaatccgcgtcgcctgactcgtctgccacaaactgaccacactgattgccgccagtacaacgaccaaccacgtcagttggcgccgtattactcgattaaggtgccacaccggcaactcacgaccacccacaatactgaggagcatcaatcccggtaatagtggcaacgcatagcgcccttctacttcccaaagtccgacatgaaaaaccgttaaaccgagaattgccagggcaacgaacgtcacggcccactcgcgccgcctcatcaaagtcacgattgcttgcaccagcatcgtcaggtagattgtttgcgtcattagaaccagccaaaattgaagctggcgttgatgattcaaataccagcggggcgcacgaatccactgggtggtcaacttaaagctatcaaaatcgccagtcgcccagaagacccgcatctttttgagtaaatgtacgagggtccccgtaacgcccatctgatgtaaccgctgctgaatcatttgctgggtctgttggcgcttggccgccacagtttgcatctgattaacgcgcgcaaaatcgtcatgtcggtactcacccgagctttgggggttcaagctcatcgcaatccagctggttgccggtaaggcggcatcagcttggcgcgtataacccgcttgctgttgggcagtccgcatcaccgcaaacatcaccccgagtgtcatcactaaactgacgagccagcctaacatttgccgaccactgaattgtcgttgccaccacaagatgatccccatcaatacgagagtgagccagagcacaattagattagtcttcatcaccacgcccacggccaccaataacccatcaccaatcaaaacgccccaacgacgccagccggttaaacttagtccgagtgtgagcaaggccaagctgtctggaactagtggcaaaacgagggcgtccgtatatgcaaatagtccaaatgcggccacgggaacactgacgagccacaacaaactaaatgagaccgcccccggttgccagtaacgccaacggtttagtaaatataacccactgattagtccggtatcgatccagataaatcggatgacatttaataatacccagggcgtctgcgtcagtttcaataatggcttgagcagattcgcaactaataacgtaaaattcacattattgggataaatcataaaataatgttgccaatgatggctgccccgcgctaataacagtgcctgctgccgaacgaaaaacgggtcggcccgcgccacgtcaacaaaactagtggcaatcaacatttgcacgatggcgattaagccgaccagcccaatcaacagccaacgatactgacgagatgataactgtttgagcacctgccggccagccatcgtcatgaccaataatcccagaaccatggctaattgaacgatcggtgacgcccagtccgggttgccgaagaagtgaatcggttgcaaccacgccatgccgactgcgacgaccaataccgcggccgccagccaattgacgctcttaaccacggccttcatccgtgcacccgttgcgaattcacaataactggctgttgagttgccgtataatcatccgtttcaataatatagcggggccggtgcttgacttccgcaaaaatttttcctacatactcgccaacaatactaatacctatcaattgcatcccacctaaaaaccatagacttgtcatgagtgaggaccagccactcgttgcggtccctagtaatccttgtattaacgcatatagcatcatcatcaaactaccgccactaatcaccatgccaaacaataaaattactttaatcggtgcgattgaaaatgacgtgatcccatcaaaagcaaaagccaccatcttacgtaatggatactttgaaacactcgcaaaacgtggttggcgatgataataaagtttagttgttggaaaacctagtcgtggtacgattccacgcaagaataaattggtttcctcataggttaacagtgcctgaactgcccgttgacttagcaatcggaaatcggcgtgattaggtactaattgcacaccaatacgctccattagccgataaaaaccgtccgcggtccatcgtttgaaaagtgaatcactacttcgatcattgcggacacctaatacgatatcgctaccagcacgatagcgcgccaccatttctgggattacctgtggatcatcttgcaaatcagcatcaatcgtaatgactatctcagcagtcggactggcgacctgcatcccagccatcaacgcgttttgatgaccaaaattacgactaaacttaagacccgtcacggttgagtactgtttttccaacgacttaatcagtttccaagtcttatcttgactaccatcgtcaacaaataataacttacttgccgcattgacctgtttgtgttggatcagatccgtcaagataccatccaagatgtgtgcagacttaggtaacaccgcttcttcattgtagcaaggcacaataatggttaaccgtggattttgcatgctaattcccccaatatgactcaaatagttttacgaaataacaattataattggtacctttcagtaacaacaagacttcttgtgctactagtagtctgaatgcgccatccactgaaaaaagctcggctaacatctcaaatcatcaataacgtgtccatatgcccccacagatagacacacacgacaattgtttttctcaccatcacgaccctcgaaaagagtggcttacaaccataataattggcaatatcaatataattattttgggccaaggaatgcggccattgacataaataattgtcagtaatcgcgccacttaccgggtcaaattgatagtaccaatatcttacgcacaattcaaacaaagcaacagtttcaacgctgatcattaacaaattagccgaacttagccgaccgctagcatctcacgattatgctcaataactacaaaacctgacgcaccaacttcacggcgctttcgtccccagtactgtccagaactgccatttctaatttaatgttcaattttttaccactttcattacgattaaaatccagtaattattttataagccgttatcatcgaatcagccgatgataaatatcaaggccataactagtggccttaggcgcagcaggcaacatatgatagctacgattgccattcgcttgccgttgcgccactagaaagtatggccggcaatgatagcgttgaacaagttgtgtatattcaaattgatgggacaccgcaatgacagtcactccggcttccagtaagccgtgggtaatttgaaaattgatttgcgaccccgcatgctcattagttgatgcaaacgactcgttcattaataccaagctagacgtactcataacgtggataagttgatccattcgctgtaattcgtcatccagcttaccgtgccgttcaccttggtcttcctcacgtttaaaatgtgtcaacaccatctcaaagggcggtgtctggtaacaagttgccatgacaaacatccccgcctgagccattaattcccccagccccacggcgcgtaaaaaagtggttttaccaccttgatttgctcccgtgataacggtcaatgccgtttgaactggcaagaagtcgtttgcaactgctggttggttgagcaataaagaaatcaagggattaatcaactgttgtgcttccattgatgacgccaacgtcgcatagcaccgtggtgccgctggtagtcgtcggcttaattgaattacacccactaaccaacctgtttccaatcgcaactcttggaaccaattgacgacttcctgataaacattcactaaaatggtggctaatttcatcactgcttgattcttgtagtgttcaagtgctttagcactatgatcatcccgttctgcaatttcaaatccctgcgcatgtatctttaacttagtaaacaccttttgaaaccgatgtggtggtacgacatcaatcacctcatcaactgttgtatccagattggtggccaagtgcgctggtaaaacataaccatgatcaaataatacctgtcgcaaaaatgttttcatcggctctagttgaccgttgaacagtgtatctagcgattgataccactgttgaagtgctggcgccggatggtcaggtaatggtttgtccaatatcgtgccaattgcctgcaaatattgcgttaatagacgacttttgttgtatagatgataactagccgactcgtgaccaagctcccaaaaattttgccggaccgtttcaatggttgtcgttgtaaactgatacaaccattcgtaatagtccgggtgcatcagggcatgtttaaccgttgcttgacgccaagtcaacgcccggctagttgttaatggtgtaaaaaataatctggtcgcaatttttgcgataacgtgatcatccgctgccataatatcaacaattggttgtaattctaaatcagccatcacggctttttgactagttgttaacgaccattcgtcaagatactgctgtttttcaagcgtgattagattgacttgcatgctttaaccgcctttcaattgccttagttgtcagttgatacttgtttaataaactagtcgcatatgtcccaaccgtctccgaacaacgatatattttataagcgcggatcgtcgtaccagcaataatttgagcctgcatcggtaccatatgtggaagcttagcaagactttctaaaaatgtgacgtagacaccatgggcctgctttgctgtcaaatgtgttaacactaattgacccaacttttcggcatcaaccgttgttgttgaagagaatagctcattcatcaaaacaatactatgctcatcgaccgtttgatagagcgcggccaatcgttcaatatcgtgctggagcagtcccgtcaactgggttgccttttcttgacgctcgaaatgtgtcagaacatgacttgctaggtgtaatgttgcccgtgagccagggatgggcattccgagggctgctaaataataggcctgaccaatcattcgaatatacgttgtcttaccaccttgattgggtccggccacaattagaaactgctcatttggattcaagacatagtcattgggcacgactgctgtttgtttgccagcctgaacataagccaactccagatcaaatcctgcttcaatccgctctggtgctcctaattcaacaagggtcggaagcacaaagttaagctggttcatccgggcaaggcgctgcgtataacgttgcaccgctaaataccaattcaactcagtcacgacttgttcataacctggaacggtatactgctgatattgttggtaaaatgtcgttaattgtgcaaatactgctggatacaacttatggagttgaacaacaatatttgcttgcagactagtatccccattaactgcttcggcagtcttaatactggcattgggacggtataactcgcttagatctgtcatgatgggtccaaacaacttcgtggcaacctcagcactatttgacgcagccaactgattagtcgtcacacggacataccgcccattgattgttaaataaaactgaacttgtactaatgcgctcgttaatgtgcgcatcattgtcagcaactgctgtgtcgcaggcgcctgcaaataagtatcgaggtcagcctgtaacttttgtagtcctaaactttggggctgaaaatgtgctaacgcctctgtaagcttttcaagttgctcatgttgctcatataatgccgttaacagatcggcggcctgttgatcagccgtccaatcatggtgagcctgcttgattttggcggccgtttctgcggcagccgtcacaaaatgtgccattaattgataccccgctggtcgcaacaaatctctaaaaatagcctgacgacgctgcaccgcttcaattgtcgttaatggttgataaaaaatgtctttgattggtaccggacagtcctgctgaatttgttcgaaaatcaaattcaaatttagatcttggaaacaacttgcagtagcgggacgagcgactggtggttgccctaaaaataacagactcatcggcattatgactcaactcttttcactaattctaatcaataaaaaatggcgacacctacttagacttaaatccaagtaggtgtcgtcattagcattactgcttgttcggtgaacaccatcaccgctagaatgatttcagtatagcacgcgcactgaccttcgttaaccactttgcttttattaaaaatttaattaactaaacatcacgcaaattgttttcaaccaggcccattaccagcagatactatgagccagtccaagcactggcatgacgaggtttccgagattggatgttggttgtagaaaaaatcggttatacgttgaatttctttcctagtcaaccgtgacgcttcaaagacgagaccagctatattgtctaacaaacagcggtattacaatcatcattattatttgaacaggtagtttttaatttagatgattatattgcaagcaaaggcaccgctgctcgccatttttatacaactagtgccgttgcttaacttgattaatatttcgcatctgcgaattatcaagggttttaaacttatggttgaaaaacgcttgtgtttatttttcaagcgcggtatgctgtaaccgttaaaaataaatggtgatgacgttcgccgtaactaattgactatcaatttgatgacgtctactttcaatcggaccttagcggggcctttgaaagtagacgtctttttttatcaacttggtcgtaaaatttgaaaggggttttcaaaatgtcagttgtaattgatgttgttaaagcacgcgaggtttttgattcacgaggtaatccaacggttgaagccgacgttattttatccgatggaacgttaggacgtgctgaagtaccttctggtgcctcaactggtactaacgaagcggttgaattacgcgatggtggtcaacggctgcaaggcaaaggaacttccaaggctgtcaataatgtcaacacagaaattaatggcgcgttacatggcgtcagtccgttcaatcaagctaaagttgatcaaatcatgattgatttagacgggactcctaacaaaggccgtttaggggccaacgcaattcttggggtttccatggcaacttgccgagcagcggctgctgagacacatcaaccgttgtaccgctacctcggtggcactgacttagaattaccacaaacattccataatgtcatcaacggaggtgaacatgccgataacggcatcgacattcaagagttcatgattactgccgtagatcgcaccagttttcgggacggatttgagaagatcgtgaatacttatcatacgttaaaaaaggtcattgaaaaagcaggctatacaactggcttaggcgacgaaggtgggttcgcacccgacttagataactccgaggccgcactacagatgttgcataacgcaattgtacaggccggctacgttcccggcaaggaaattgcgattgcttttgacgccgctgcttcttacttctacaatacccaaactaagcaatacgattttgaaggtcggcacctctcaccagaagcattaagtgattattatgctaccttattgagccaatttcccgagattatttctatcgaagatccttacagtgaagatgactgggaaaactttgttaagttcacccaaaaatatggtgatcgggttcaaatcgtgacagacgataacgtctgcaccaaccctacactcttcgccaaagctatcaagatggggatggccaacacatttctgattaaattaaatcaaattggaacggtcactgaaaccctgacagcaattcgcttagcacgcaaaaatggctacgcaacaatgatgtcccatcgttctggagagactggtgataccttcctcgctgattttactgttgcaacccgcaccgcacaactcaaatctggggcccctgctcgttcagaacgtgttgaaaagtacaatcaactgttacgaatcgaagaagcacttggtacagaaggcacccggttagcgcattttccagatgacgtcgatcacgacctctaaaatcgcaattgacggagcaaccaaacagaggtgattatcatgcaagcacccacaaacatactaatggggctcacaacaactgaagtacaagaacgtttgcagaaatacgggcccaacgtggttcctcaacgccagtttagctttcgtcacgccgttattactcggctatgggaaccatccgcgtggattcttgaagctgccctactcgttgaaatcctgttgggtaaaacgattcaagctggttttattgttttgatgctcctatttgctgctgtcacgggcgctattcaagcatggcgctctgacaaagttcttaaaacattaacgaatcaattgaccttaacggttgctgtcaaacgaaataatcactggcaacacgtttcagcaacccaaatcgtccctaacgatgttattagtttgaacaatggcgatctactacccgcggatgttcaattgttagatggcacactagaagtcgatgaaagtagtatcagtggtgaatcacgtgcaattcgtcatcaagctggggaactagtatatgctggcactgaaatcaagagtgggcacggattagcagtcgtcgttagtacgggaaagcatagtcggtctggcaaaacaattagtttgatcaaccagtcatccgcacccggtcagcttcaaaagctactcagcaaaattattggttatctggccattttggacaccgtgctggcgattgtcttggttctcaccgcaataatacgtggtgctaacttgattacaatgttgccatttctggcgatgctgtttatcgcgacaattccgatcgcaatgccttccagctttgcagtggccaactcagtggaggccaaacagttaggtcaaacacacatcttagtcagtgatttatctggtatccaagctgcggccaatctgaatttgctactgatcgacaaaaccggaacgattactgccaatcagccaacggtcgtcgcaatgcataacttttcccaatattctgaccgcgaactaatctgctgggctactagtgctactaatcaacaaaatgcaagtgtcattgacgctgccattctcaactatgcccgtcagcaagctgtgaatgtacaagtgcccgcacacttcgagccttttaattcacagcgtggttattctgaaggaacggtgctggccgatcagcccattaatatcaagctaggcgcttaccaacgcctgtatcagcttgatcaagatgcttcaaaattgacgaaccaaattgactttagccgcggtcgtaccgttgcattactagtcaacgataagttagtcgctttattcatcgttgaagaccagccacggccagacagtctgcaagcaatcaaaaagattactgatcgcggtgtcaaagtcattatgttgactggggataaccagaagacagcggcaacggtcgcacagcaagtgggcctaaccggtaatgtcatgccattcaacacattgacggccgatacggacccccaacaattggctggaattacagaagttattccagaacataaattagcgattgttcagcgttttcaaaagttaggttacgtcgtgggcatgaccggcgatggtgtcaacgatgccccagctttaaaacaggctgacgtgggcatcgccgttcaaaatgccgtagatctcgccaagcgttctgccaaactcgtcttgctgaaacccggattgacaccaatcattcagattcttgatagcggtcatcgtgtttaccaacgcatgatgacttggacaattaccaagttgtcacgaacagccgaattaaccatgctactcacattgggcttcttgatttggcaactgattccgttaagtctgaatgccatgattctggtagctatcttaaacgactgtgtcaccctcgtcttagggaccgaccgcactcacattacgtaccatcctgagcgctgggacctacgccgtttgagtaaaattgctggtgttttagcgattggatggacgacccttggaatgggtgttttatacgaagcacttcatcgaggattgacgccaggtcaaattagcaccgtactatattgttatctaatctttagtgcgatgctcacgattctaatgacacgcactaccaaaccattttggcaacaacgccccagcaattccgtaatcattgccatcacgatcaactgcctgattacggctggtctggctctgaccggcctaggcattgccaaaatcagtttatcgtacctattagtcacgttggcaattgttctagtcatgggggggttactcacaattattcaaccacgtcaagattaactcgacagaacgctataaacgctggaacttctttgaataccagccaattaaaaagtgtgccggggcaaggttgggttatgtctatcgcactattgctcagtgacactagtgttgggaggattttgttcatgtcgttgaactagtcacattgaactagtttggtcgttacaattaaattcaagaatcgagtaggaggtaattgattatttcaattaccgacctctcacaccaccgtacgtacggttccgtatacggcggttcaataatttaagcactctgtgtatttgctggagtgtcttggacaggtttattagtccaagacgctccagcttttgatttgtatacgtataggttagtgttttactatgggcagttttccaatattccttgcgggtattggcattagtcttggcctgttccggtgtcattcctagcttaattagctcacgatatcgggttttgattttcttccaccgtttccatatcaactgtctaatcctacttcgcaaccattggtccagttgttgaataaacgtcttcatcttgccaatcccatagtactgtagccatcctcgcattttctgtttaatttccttcatcaacattaaccaactaattccgctacttcgcccagtcattatcttaagggcttgtttgattcgctgtttcacgaccttgtgcggtcgtgcatatgccccattacggtctacaccgagcgtaaatcctagaaactttagtcggagtggtgggccaaccgtcgttttatgacggttaattgttagttacaacttaatttcaagaaagattgtgacattgtgtaagactcgttctcccgctcgcttacttctgacataaatattacagtcatcggcatagcgcacaaattggtggccccgctgggtcaatagcttgtccaactcgttgagataaatattggccagtagcggcgacaggttcccaccttgtggtattcccttcgtcgtctttcgaaaaagctcgccattcatgaccccgcttgttaggaagcgccgaattaggtggagtagccatggatcagttactcgttgtttgatgaagttcattagtaagtcgtggttaaccgtatcaaagtatgccttgattgcagagttcggtgacactttgaatcgcgtcatgcgcactccgacctggtcggaatccatagctattgtcggaaaatacttgttcgtatatcggcgaaagcacctgtaccacagcttgttggatcatacgatcaacaactgtaggcactcccagttttctggttgagccatcgggttttggtatctctacccgtctgactggttgcggccgatatgttccattacgtaaactctctaggagttcttcccggttcttgtaaatatattcggccagttggtcaacggtcatgccgtcaattccagctgcacccttattcctccgaacacacttaaacgctaggttcagattactacttgcaaagatccggtctacaaattgaatgccatcctgcgccgtactttcaccgttagtagtactatgtgcccaagatactctttgtcttccagactatccatcccttggcggtcagcttattctgttttctgtaatcttcgcactaccaacacctccagtatcggtgagaattattattgttcagtccttcatctgccatacggcagattactatgacctcggctgactagtttactcctgtaaacccatattggcgtccttgttgggagcttatccgacaggcctccccgggtaagaatgatagctttcataccatgcaaccgttggctttactaacttcgacttcgagtagtgtaggacttcagtttgtgaagcaacttcatccagtctaatcagccttgtagccactctttgtacatcggttcggtattttgtcttaggcttccttcagactccgtctcacagcggacgcccttgccctcaactcgtggttccgactactacggcccacagcggacttacaccgcctagttatcacccatgccgggcgcacttcaaaggtggatttccagaatttctggaagcctattttgatgctaatctcaatcttagtcagtacttatttcaaatagccaattaacgaaacggcacccacacaacggctaaaaataaaatgagccctaacacgatcatcattaagtgctgctggccttcattcgtttgcggtaacgttgccgccttcgaagtttgggcattcggcgctgtggattcgcctaacgcataccttgccgtggtaccggtttgtgtgcctggagccatgatttcatgaatagcccaagccatcattttgcgtgatctgagtcgtatttgctgacggtgtaccagggactggcatcccccgctgtttcggttcagttgttcccggctgctccggttcggtcggctgcgcctatcgatcagtcgccgttactgtcactaccgccgtctgaccattcacaattgtgaagtctagcggcgtttgatttaagtcataactcgctggagccttagtttcaacaaattgatatcggccagggattagcttatccacacggatttgacccaaagcattggtgaccaacccctgctgaatcgtcagcccggtagcgtcaatcagccgataagttgctccagccagcgctcggccattgctagcatcggttttagtcagcacaactgccccagtgaccgccaccttttcatcaaattgggcaacttcaactggtgtcgcaattgtatcgacatcaactgtgaagttgattggtgttgggttcaaagcgtagcccaatggtgctttggtttcgacaaaccgataatgtcccggaactaagccagccacattaatggcaccctcttcattagtcgtcaatccagattgaatcacttcaccatgctgatcctgtaactgatattcagcctcactcaactcacacttaatcgtagcatcgcgtttgaccaaggttacgctgccaagttgattatcactgttaccagtcccattacaaccataactaacattgccactaacggtcgtgccattcatagatgcgaaattattccagttattactacttcccgaaaccttcgtcaacttgctgttataaactatgttaacggcagtcgtaacattgctaaaagtgaatgtcagttgattgccatcaactgccacttgtggcacaatcgtccctgactgcacaaaattaccggcatcgttgtaggcgcccgtttgcgcaattactgaatcggggaggtaactttgattggaacccaatgtgtcattgacaacaactgttccaagcttcttaccgcttggattgaatgcaatattccatgttaaagttgcaggcaggccatgctcatcatagcttccaatcaaaatatacatcagaatcagccgtgcctttcacgtaaaactggagggtactcgcgcgattcgtccccatttgtgataaggcatcgttgaaagtaatcagtccagcggtttcacccgctttaattttaaaatgaccagcaactcgaccattatcgtctttcaatggaaaccccaaatcaacgggtgcaaccgtcccattcggcaattctgtatcaccggccgcaattggttgaccattgcgaatagcccagtcatactcgactgtaaaatcctcccatttgcttaattgacttgtatctgtgatgacattgccataccgatcagtcactctggcctcattccccgttaggccagccgtcggcacatcatccgcttgtccaatccgtcctaatactatgactgtcactaaaactgttaacagacctagtaggactgaaaacaatttatttcgcataaaactgcccccattctctgccaaacacaaccaactttgatacttagaatatccattggaattaccaatagttctacgatcactttataataagcccatctttttcatcagtgttattaataagttgtcattggtagatttacaaacaagttgatgattaatcaatcgctacccacgttacttatttagccttccaatggccaacgtcaccgtattttttaccaacctgacatgacacgtctccactcagaccatccattaaaaactgtttgacgttagcgcctaaaatctctaaaatgaacccattggtctttattatcaaattaattttaaggagtgtcttcatggcgcaaatctatattgctagtccgtttttcagtcccgaacaagtgacgcgggtcacacaacttgaggaagctttagcaaaaaatccaaccgtcacggatttttattcaccacgtctacaccaggacgctcaagccgaacagttcaccaaaacttgggcgaccgaaattttccaccgtgacatggcccaaattgcggccgcgcaagtcatcgtgactgtcttagactttgaagccaaaaacttagattctggtaccgcctacgagctaggtgtggctaccatgcgcgacttgcccatcatcgccttgcaggaaaaagatgaggccgtcaacctgatgattaccgaaagcttacactggtataccaaacaagtgagtgattttgaaacttacgacttccaacaattacctaaaggcgactttatcggtgaaattttataataaaaaacgaagccagactttcgactattatcgaaagtctggcttcatattttgtagttcttaattttacttaccagtgggccccaatcgtctgttgccaagcaaagtacggggtgccctttgtcaatgcttcaaattgatcagccgtcaaattgggccagtcgatgtcactggttgccaattgtaacgaatcggttaagtgaagatgaaagtcggtgatccaagccaacagcggtttcaacactgacaaatcggtatttaacatctgataagtagcggtatcgctggtcaacgtcaccgccaatgtgtaacgggccttcattcgtacgccattaccaagttgccgcacgattgagcgatacaatcccagctcgacgtccgtgatgactgtgggtattggcgccaaggtttgaaagactgtgccgcgctcatcggccaaactcagccgactaggcgtgatcgtcaaacgcccatgagcagccgcgccctcattcaacgctttcaagataaacggcgtctttttgcgcgcggtcgaatacttgtgatcatttaaaacaatcgtcatataagctggttggtgcgtaatattgtccgcaatgttcgtcaccgcgactggcattggtttttgcatgtgataatctcccttgtcgatctgcttctctctacggtcgattatacactaacacgactcaaccaacgtagcgacttaataattgccttaggccgtcaccggatcaacgtgctcagcaacagcatgagccgccgcgattcgaccgaacgtaaagatatcactaagcgagttaccacctagccggttacccgcgtgaattccaccggctacttctcccgccgcgtatagcccgtcgataacctggccgtccgtatttaaaacgtgagcatccgaatcaatcttcaagccccccatcgtgtggtgggttgctggtttacgcggcgttgcgtaaaatggtgccacggcaactttcaaatcaaaggccgtcttatgaaattcaggatcctcgccagcatcaacgtaacgattgtagtccgcaatcgtcttggtcagggctgccgggtccatgccaatttggtgcgctaaatctgtcaaagtatcagcacggaacaaggtcccattcgccacctgctggtcaattttagcttgtgtcgtgttgtaagccgtctttttaatttcatcatcggcaattagatagaagagactcccattatcaatggccgcctgagttaactcatcacgactgccgtactcattgacgaaccgttttccttgctggtttaccatcacaaagtttgccggtggcacttggagcccactgaataattcgccggtctccggatcagataccggcatcatttgtgagaagcccatcccaactaatgctgcaccaacactagtccctagccgaattccatcaccagtcattgcgggggaattagtcgtcttgacatcatcgtcgatggccgtccagtacgtattgtacttttgtaacattttagtattcgctgcgaaaccaccagaagctaaaatcaccgcatcagcatggacaataactttttcatgagccgcattagtcgcaatgacgccacgaacttgcccatctgtcacaagtaattcttttaccggcgtttccgtcataatcgtaccaccctgttgttcaacaaaggcccgtaaagtcttgatgtaagcaaaacctagatcgcccattggcttatgcccgcgccgccagatggctccaactggcattgtcacttggctttcatcaaatttcacaccaatcgattgtaaccacttgactgaatccagggcgttatccgtcaattcttttaccaaatcatactgaccgtgaatctcttgaccgttcaaatcagtccgttgaccacctaaataagtttgaatccgatgtaacaaggttgaatcaaataaggtgcccttttgattggtattggcagtcaggtatgcgtcaatctgctgtttcaatttacggaaatcagcccgatattcaggtgcaattgtactttcatcacgctcactcagatccttcaacgtttgcttttcacctggcaaagctgcaaactgtcgttgccaatccggatcagccgcattcatgggccccccagcgcgaacggtattaccaccgacagctgggaatttttctaggacaacggcttgatgaccagcctgtaacactttggccgctgccgtcataccagccccaccagcaccaaccactacgacatcagtcgtcacttctttgacagcaggttgagcgacctgcttagtcgcacgccgtttcttcaaatcatcaggattggcaccagcttctttgaccgcacgagcgaccccatcgataacaccatgactggtaattgaagccccggaaatcgcatcaacagcgagcgtttgacccgcaataatctccttgggaatgcgttcaaaagccacatcggcaatcccctgcgtttcactactggtatcaatttcaatattttcaatccggtcagcggagagggtcactcgcattggcaattcgccattatgtccagtggccgtcacctgataagtacccggggcaaagctaagcgcttctggtgcccgcatctcggcgacgatggtcgcaaacttctgaaactttgcaaaacaactgtccagaaaatcaaccgtcccttgcacctttaaattaccttgatcgtcaaaagccgtttgggcacgacctaataagaattctgaaccgggcatgacactggcgttaacaccgggagcgtctaaaatctgacgcaggtgtagttgcgcgcgtgacgatccttggacgctgtatgaagccccaacaatcattactgcttgaccatctaatgggtgaattttgaatgataaccattcaataatgcttttcaacgcggaaggcacggaatgattgtgttccggtgaggcaatgataaccccgtcagccgtcgcaattttagtggcaaagttttgaatgatggtactgtcagtttgatcattcgattcatcaaacatcgggacatcagtcaattctaaaatttcgatttcggcttgtgtcgcaaaatgtcgttgcataaattccagcaacatccgattgtacgaatgctgagcattcgttccaacaattccaacaaatttcatgtttattcctccccagtcacttgccgccacgagaactgcttactcttttcgaaaaactgactcgacggcatgattttattcgttaaatctacaaaatcaatgaattcgccaaacgcattgtctaattcctgaactttatccggataagtcaggtcgccctgatcatcaaaagcttgtagtgaacggcctagtaagtattcaatatttggcatcaccagtgcttttaattccggcgcctctaaaatctggcgtaagtgcgcttgagcgcgtgaggttcccagtgagccgttcgaggccccaacaatcataactggtttattaattaacggccgcgtggtatatgacagccattcgattgcactttttagtacggccggaattgaatgatcatactccggcgtggcaaagatcacgccatctgctgcggtgatcttatcactgagctgttgaattgctactggtgctgttcggtcttccggttcattaaaagccggtaaatcttttatttcacaaatttcaatcgtggcttgttgctgaaaatgccgttgcatatattgcagtaactgccggttggtcgatttggttgcattcgtcccaacaatcccaacaaatttcataatttcagatcctttcaggatgatttaaacagtcgttttcgacgagtagctattgaatgattggccactcttaatactgattagtgtacgtgaaagcgctccgcttgtgaaatatttatttatctataccccgataacaaatttactatgtcgacgattcgcgttaaaattaatcatgttaaaatggttggtcataatgctatttagccaccatcgccaggatgttgacagaacttattgaacatgttttgaacgtccttatggcgatgcaactaactcaacatgaccaaatcagcaatcaaacgaatactcacctaatcacaatgcgagaggaaggcgctttatgccaaaatcagattctagcgaaatgcgacggtttttagatgtgttgctcaagcacggcaattttacccgggcggctaaagatctctacatttcacaaccttacctcacccaaagcatccgcaatgttgaaaaagaattgggcgtcaccatcatcaatcgtgaagtcacgccactgcgactgaccacggctgggcggacttattatcaatatttgacggcgctcgaaaacgagaaggattactttaataagcaaattaggcaatacacacatgccaaccagcaagtaattcggctgggcgtcttatctagcctcggctattacttattgcccctattcttacctgcttttttgaaagcccacccggccactaagatcgaattaaccgaagatatcgctagtcgcaacgaacagcgcgtgctccacggtgagctggacttcttaattggtcaaaatccggaaaccatcgcgccggggcttgaaagttatgaccgcggtcgggacgggtactacgcgattatcccgaacaccgtcaactggtaccaaccccatcaggccttcattaatccgggagcgctaccccttaacgacctgctacaagcgcctctagtcttgtctccccacgggtcatcgattcgacgccaagttgactacttattacaaaagcacaacgtgacaccgaatatcgtaattgagagcacgaataccgccaccatcaccaaactagccactgctggactgggtattacctttttaccagacagtgtgcatacccagcctgatccagaacgctataacatcttacctttgccccaagcgttaatgtccctgaattatttcattgcctttccagccgagcattcactgaaccaggtggaaaaagacttggtgacgatcttcttaacccagttagaagccgatctggcacaatcgtcaacaatttcatgatacaacaaatacccatctgcttagccgttaagacggccaatgtagatgggtattttaacagtaaccattatttcaaagacgcaccagttaagatatgcttttcgttgcgaaattttgacgccacgcctacactttagctaaccaatacatgctaatctagtcacgaaaagtaaggatggcttatcatgataacgaataaatgccgttacggactggtaggtctaatttcgatagtcctaacgtttggtctttccgcttctaatcggctccgtgcgtccttcaacgctatgccggctatcacctacatgtcaaaatatggcattatcaaccatcgcacgcaatggcaagccatgctacatgcgactgatcatggtcgcaaaatcacgtcactgacccaactcaatcaaattctgcgcgctgcaaatttacattcattcgccgtcgccaatctccgccaagtcgaacatgccacccgtccgaccaagacaatgagtgccggcctcaccatcatcaatgtgccagcattttaaagcagtcagcaccaattacaaaaacagtattggacacaactccagcacctgattaaacaaactaagccgacaaccgatttaatcttaaacttcgcagcaaatactggtggtagttcggcaccgatgattgctggcctggccgccatcattccagacggcaccctctacaccggcatcacgaaccatcatcgcaaccggccacgtatgatgtaccatggccgaatcactggtggactcggtcaagatgactttaacttttcgcaaccaacagcggcccactttcgtcatatttatgccattattggtaaccagacagcgagtgccgcggaggtgaccatcatggcgctaaaacgtaacccgcacgttactttagttgggcgttcttccgctggatatactagtctcaatggtggcgtctttttaaataccgccgtggccgtcatgacgattggaacgctcaaagcgaccgtcaaaatccatggtcagcaatacttcaataaccagccgttaaagccagacataccaacgttatatcagccattggcaccattacaattaggacaatcgccccatttagatgccgactttctgtccgagttacgaaccatcatgaagcactaccactgacgccccgtcctttcagcttcaactactggattcacaaacttcagcctagtcaatcggcactattgtgattcagttggccgttcagctgcactaaaaaatcagcttacgcagccaccgccatccccaaattacaattgtaatcagaatagctgtgaccagccaagcaactaacacgataccaatactgacggtagctgccagtgcacggttcgccatcttcacagttgccataccaggcacactctcaggccgcagtacaccgtaagcgactaagcgcattgcaatcaaaacggtactataactcgcaccaagttgccaagctggccgagccgcgccatcttcttcactctcgtcttcatagtcgtccgccggatcaaaccgtcgggcccactgttcagttgtcaacggatctgctaaatcccagtgttgccaggcatccgtccagttggctgtcgtctcatcattgagcgtgtcatcgagcgtgcgttgcatcaatttattctgcaaagttgccttggcagtcaaatcaccgtcccactcaagctgatcaaagaactcaatcgctaacgacaagccctgcatgagcgtaattgcggccggatcaatctgacttttcgccacaagctgtgaccattgcgcgtccaaatctcgatcagcacttttttgccattgttcaagtcgattaaccaattcaaaaatctcaaaagagtcctcagtatcctggtacttatcgaaaaaggcccacatcacggctggtaattgttcagcagtcaacgtcagcggggcggcagactccggatgcatgctctgacgatgtgcacgccacacttgccacccggcaccactgacctgagtggccgcccgtttaccaatttcttgcagatattcctgatcttgtgcctgcaaaaacgcgttcatcgctgcataggcttgaacttcttctaattgacgttctggtcgtaccccagctggtagcactaattcatcctctccgtcggtctcatcaacttcatgttcagcatgatcattgggcgtaagcacggccctaactgcccgcttccatgcttgccacattggatcatccgccgttacctcataaattgccccggcttgcatccgatttagtagtgacttgacggcgtcatcgatttcatcgtcgtcaaattcatcctcaagtcccagatagctagtttccaaccaacaatccgcgagccaataaaatgtcgttacatatgcttcttgttcgttcatcccgataatctcccctaatgcgtgcaattttaaatcatttgtctctgtgacggtcccgtcacgtgccacagttgccggattatcgtttaatcaatcagtctggccgctagattacgcgcatcgtgcacgccaatactgctcaacgtgccctaattcaacacgtatgcaatggtcaacgataacaactaatcactcgtagtaacttatcatgtcaggatattaattgcaattaaaatttttattttatctttaatgacggcccacgctaattaatggtgcaacgtctcacccaccccaatggaattcgtcatcaaaaataaaggtcacaaaaaaactgttaaaatcattgatttcaacagttctttcaaacaccgtatcgatttagttagttttgttcgtctggtaattcgcccttcgtttgatcaccagttggccggtaaaagttacgaccatccatagcaaagatccgctccgtatacgtgcccggctctgcgtgtccaagtgaagtctgcatcatttgaatcgacgcgtccaactcgtccaagtcatgtaagatttcagcttccataatatgaggccgaacgggtgacccatattctaacaaaccatggtgcgcaagaatcgtatgccgcaagactaaaacagattccgactgctcgtcaattttcaactgttgacaagtctccacgatttgttcatcgatcaggacaatgtgaccgaccaagttccctgccaacgtataagtcgtcgagaccggccccgacatttcaatcgtcttacccatgtcgtgcaaaatcgcaccggcgtatagtaaggcccggttaacgtggggatactgatcggcaactgccttagctaagcgcaaaattgctaacgtgtgataggctaagccaccggcgaacgcgtgatgatttttcttcgccgcgggatagctaaagaaccggtcatgaaatgtcgttaacatgtggcgaacaattcgattccaattaggttcagtaatttcaaagacaaactgattgatttcgtccgccatcgtgtcggtctttagtggtgcgtgttccacaaattgttgcacttcttgcggttcgccactatgagtgagccgcatttgttgaattttgatttgcggattaccctgatagttttcgcgtttacctttcaaatgaacgatccgacctgcctgaaagttttcgacatctgtatcgcttgcatcccaaaacttcccggaaatctcgccggaagtatcctgaaaattaatggctaaaaacttcttgccgttcttggcgatgcgaacttccgaatctttcaacaaaaaatagccatccacggtttcatctaattgataatcaaataacttctttgccatgttatcccccctaggttaactgctgtacagtcgctgtcttcagttgggtcagtgccgctgtctcattcgtaaagtagagcacttgatgatgctgagcaactgctgctaagacttgccaagcagcttgcttacgttgctcatcaaaattcaccaagccatcatcaatcattagtggtagctgagctgcttggcccaaatgattgatcaacgctagccgtaaagccaagtacaactgttccttagtcgccgttgaaagttccgcgaccatgaactgcgttgttgccgtcttcacaaccatttcatcaccgtctaagtcaatcttattataccgctgtgccgttaattgcgcgaaaatcgtggttgctgcggccaaaacagttggtaattgctgttgtgtcaatgcctgcagcgccgtatcgatccagttcgcacccaactgccgcgttagccattgacgtgccatgactgtgatttccgtttgtagatccgcctgttgctgacgtagcgtagcgtactggccatccgccgtcaactcttggagttgtgcttgcgccgtggcaatgtccgtagctaactgtgtcagttgctgcgccgtttgggtacgttgttgccgtctttcagccagtaccgcttgcaacgcttcaagcgacgtatactgctttaacgccgatagctcagcagaactgagttgttgctgtaattgttgacgactcgtggcgttggccgtttgcttttcggcatcactaaccgcttgcgtcaacgcgtctacatccgctaaaccgttggtcgttgctaacgcctgtagctgctcggtcagatcacggacctgctgcgtcaactgctggacctgccgctggacaaaggcaaagtcggggccggacatggtctgctgttgcatcacttgatggacttgatcatagaattgggcaattcgagtaacacttgtcgttaaatgatcctgatcaacaggaatccatcctgccgcaaattgataaggctgaatcaattgccagagtttggcagcctgtgttgctaatgcttgatcagcagtcgtgaccgcagcttgtgcgcgttgcagtgccgcgactagttccaattgctgtaaggcttcactggcagtcagattcggtgccagaccagcagccactaattggtctgataagtggtcggttgcttgcaccggtttaccctgactacgggtcatcccaaaccaaccaagtagggccacacctgctaacatcaagatccatttaaagccgcctaatggtagcaataatcccgcaacaatcccgattgcaccaccaatcaagcgccaatcaagcgatggactattcggggccggatgttggcgacgcgtgttcgccgtcgctgccaacgtcgccttcaaggtctcgattgcggcctgtttgtgcggagagaggcaacctaacagctcaggatgtgcattactttgcgcttgaaaatcagccttggcagcacttccctgctgggtcaacgtttggtattggcctaaggtttgttgcagggttggtaactgagcttctaattggtcaaactggtcttgatgttggacgtagaagccaactagtccttgagattgtgtatcaactggttgctgacttaattgctgacgtgcactcgccaaggcgtgttgcaattccgttcgctgttggcttaattgttgatagcgtgtcctagtcgccgtagttagtgtcgtcgtcatattagtggcttgcagttgctgcaattgttgatagaccggccactgatttcgtaaattggcgagctgttgttgttcatgatccaacttggttaaatcacgttgggtacttgtccgttgtgcctgcaaatccagcaatcgattttgtaatgtttcgtattctgggtaccgttgcttggccgccttgacctgttctgtcaacatgcgatagtgctgcaatgcttgattcaacctgggtttgcggccgcggggcttatataacgcctccgcatctgtccgtaacgtagtcgccgtttctcgccatggtgcactgcccaccaatccgacttgttgtaattgcacgttcaaatcgctggcgtgcatagttttgagcgccgtcaattcagcctggttaaacgtaaacaatcgcaaatactggtcacgatcataaggcgctaaccacttgtcaagtaaggccagcggttgagcggcctgcgtctgcacgttcaccaaggtagcgggttgatcacctaaccgggtcaaccggtatgtcgtctcgtcaaccactagctctatcgaaccaccgtactgattcgtaccttgtggttcatggcgttcaagtgggtgacggcgggagggaaaaccaaataacatgccgagaataaaggcccgcattgttgatttaccactttcattgaggccgtaaatcacttgaagcccatcaccaaactcgaactgctgctgttgaaatttgccaaagcccgcaatttcaagacgcttaatctgcatcatcattcacccccgtcgttaaatggtactgatcatttaagagtcgcaccacttgttgttgccaagcagtgggtgacatatcttccagcaacgcggtgttcagaaagtcttcatccaagagtttgcctgcaagttcagcgactgcttgatcggtcacgacctgctcaccaacttgttgccaggtcgtcgcgttaataccaaacaagggggtcatcgtatccgtcgttgcttgctcaatcgcaaccggccaccaatgttcatttgcctgttcctgcaactgggctagaatggccccctgatttaaggctaattccgccatcgcactcagttgaagactagctggtaacgtaatcgttactaattttaagccggtaaccatcttcaatgataattgatcagctaactgatggacgatatgtgaacgggacatgggttctggactagtgagcgttggcgtccaatccgcccattcaatatcagtcaaggcgtgaaatactggttgcaaggtctgatcggcctggctattcacaatgaggcaccccttcgccccagtttcaccgcgatggcgcccctgcgtgttgccggcatatacgattggtggttgcgaattgagcgtttgccgctgatgaatatgaccaagtgcccaataatcataatgtttcgttaataattcactaacgttgaacggggcgtagtggtcacccgccacaccaatctgaccgtgcaaggtaccaatctgataatcaacgcccgtggctttaacaggataatcatcaacggggtccgtcgtcacccaccgctgcgcatagctaaacccactaatcgcgacccgttcttgtgcctcagtcgttaaggtagccgttgttacctgcgggccaaaaacgtgcacattggccggaaagtgccagcgacttaaatccgcctgaaaatcatggttaccgaacgatagcagcaccggaatcgcagccgtattcaaccgcgctagcgccgtcatcagtgccgcctgggcctgaacactttggccctgttggtcaaacaagtcaccaacgagcaggacgaaatcgacttgctcagccaccgccaaatcgactagtcggctgagtgccctcagtggtgccgtcactaaccgttcctgcaaagctggtgttaagccactcagtccttgaaacggtgtatctaaatgtaaatctgccgcgtgtagaaatttcatgataacccccactaaaaaaggggcaatcacggaacagattccgtcattgcccctcgatccttaatttacttagttctggtataattcttgaactggtttagtgataatttgatttaaatcattcatcaattggttcaagttacgttctttacccattaaggacttaatttcgtcaacgttgccaaccttatcagctaaatcatgggccttttgaacttcgtcatccgtcaattcttccccattcatctgcttttgtgacaattgcatctgaacttcttgaaagtccttaaacagtgaaaaggcactgtcattggtcttcatcgtgtcataagcgacctttaattccttgaattctttagtctgacgtaattcttgttccaattggttcgcagtatcgtaaatatttacggccatcgtgagttcctcctcgaagtatgtgtcgtcattattttagcatttttaacggaacttgaatagcattagtacgttcagaagctagctttactagttgccaaggaaacttttggctttggagaaccagtctttagccttgttcttaactgcattagcgcccttctcaacgttttcccatacggatgatccactatcagaactatccgaatcactactattagattcggttgccagcgtcgcagcatccttcgtaccaaaactagtattattcgtattcggcaaaatattttgtaattcattcttgaataacgaggaaagttgattttcagataaactcttcaaataatgagtactgttcgtcgtatcaaatccgatccaggtcgtgaccacaatgtccggggtataagcaatcatccactgatccttcgttcccgaacccgtactgtaatcagcctgcgtactcccagtcttaccagcaaccgagtatccatacggcttggccgcagccccggtcccactattgtacgtgccaagcatcatactggtcatttctttagcaacgctggcggacataattttcttcgtcttagtcttcgtattatcgacaacgacattgccactagcatcgacaattttcgtaataaagtgggccgtcgttttcttaccaccattcgcaaacgctgtataggcactggtcatttgagcgggtgatacccccgtcgtcaaaccacctaaggcaagtgccagattatcgtccgacttggtaactggtaagccaaactttttcaccgattgataccctttattcacaccaatcttattcaataaccaaaccgccggaatattcatactttgcgataacgcggtatacattgggaccgatttactataaacattatcatagtttttgggcgcatatttattggccccaaaagtttgcttcttattagaaaggttcgaatcatacgtataaccattttgtagtgctggtgtatacactgccaacggtttgatcgtcgaacccggctgccgcttaatctgagtcgcacggttaaagccccggaagacgtgtttgccccgaccaccgactacggctaacacaccacccgtcgacggatcaaccgcaattgaggccccttggaccttcgtaccatcgtccgcgttggccgggaacaacgtactatccttaaaagaatcttgcatctgtgtctgatcatcttgatcaagcgacgtataaatcttatagccccgattcataatgtcagattccgttagcccgtacttattaattgcttcatcaatcaccgcatcgaaataatatggataattataaccactttcataatggtagttattcgtcagcgtcatcgccttttgcgaatagagcttatactcacttttggaaagcttattattagcgaccatgttattcaagacgacgtttcgacgagccgtagacgctttcggatgattgattggatcataaccgctgggcgagctcagcattccggccaaggtcgccgcctggtcaacagataactctgacgcgtgtacaccaaaatatcgttcagacgcatcctcagctccccagacaccgtggccgaaataagcgttattcaaatacatcgctaaaatttggcccttagaatagacattttcagtttcaatcgccaaaaagatttcccgaaacttacgtgagaaggtctgttgttgtgttaggtaggcgtttttgaccaattgttgcgtcaacgtactcccaccaccactaatgtagtcacggccaagtatcttattgataacgagcaggacaaatgcccgcccgattcctttgactgagaaaccatgttctttatagaaattacggtcttcagtcgaaattaccgcgttctgtaagttttttgaaatactactcaaatggacataggttcccttttgtgaatagagtgaaccggcctttttattgtccttatcatagatttcagttgtcttttctagctccgcctgtaaattaccaactttagccgtcttggcttcataagttaaataggcactcccaattaagatgacggtcaagacgagtacaattagccaccgtgtgatttgtcgccggtgccattggtagccgacgacggcagcgaatcgctgccaatagggtgctaaccaattgccaatgactcgtaagccgtctttgatcgtggcccaaaaaccatttttttgcataatcttccccttgttcagccgacgcacctgtcacaacgtccgcgttacttgttagcttttacaattgtatcataaattttccgatgctcagtaattgaccacaaccttgaaaaaatcttcaacaatcaaacgcaactcattttgtagataacccgatgtttgccagttgttgccgaaatcactgatttaggccacgtgttgtaaccagattaaaggtcactacgataaaacggccataaacaaaaaaagcttccgagccgtccatatgacatacttgaaagctagctcagccattacttgcgccggacaccccggcggttagcgttgagctcattttgttgttgtttaaatttatcgaaggtcgcatcgcgttgtttttgattctttcgaggcgcccgtttcttcgtatatttcatatctcacacctcttttgatgacaataatcataccgtgaacgacggcttagtgcaaccaattagactgctcaccacagtcagtcttcattactaatgtgactagcaaaggattcgtatagctgctttgccaccgtcgtattcggactcacgacaaagatcgtgtcgtgaccagccaaggtcccactcacttctggcaagttcaaatcatcaatgatcgccgccaatagattcccattactcggtagcgtatgaataatattcatgaattcaacacggtcaatgctcgtcaccacatcgtgtagcgtttcaaatagccggtcctgttcatttttgttagttgttttaaaaatcgcgtaccgcgtctgaccgtgctcatccggcgtcttaacgatctgcatctctcggatatcgcgcgaaatcgtcgcttgcgtcgcagcaatgccctctgctttaagcttagccatcaattcttcctgggtagcgatcggatattcactaattaattgttcgataactgcttggcgctctgactttttcatgtcgcgaaacctccccaaatcttgtaatgaatacattataacaaatattcacttggcaaactacgcacagaacttcaaaaagcacattttccgccactattaggaaaatgtgcttaaacaaatttgtataattatttaaaagtaatgagtcaaccacggttaccagtccactagtaactaatcaaagcggcgtaaatattgccctaataaatccagaccccgttgtaacgtcggcgtatccgtacagtaacctaagcgggcgtgccccggaatatcgaaacgtgaaccaggcactaataaaacaccggtatcccgcagtaattgttgacagaacgtctcatcatcgatcggtactattagtttaatacacgacactgaaatgccatgtggcgtaatcaattcgacccgcggttcctgtgcgacccactctgtcagaattttgaggttgcgactgactagctcccgatttcgcgccagaacgcgttggcggtgcgctaaaattctaacggccagttggtcattcaaaacgcccccacagatcatcgtataatcacgatacttccgaaaaatatcagcaatggcttgactaggtgtcgccgtccacccgatccggataccaggcgctgaataggtcttggataaactgttgaccgcaattccacgctcgtataaatcggcaattgagacgaacggggtttcatccagtggttcgtagacctcatcggccaaaacgtaagctccaactgagcgagctaatgtgacgacctgttctaacagtgttcgatctagtaaactcccagtcggattgatggcattattgagtaaaatcatctttgtttccggccggatcaagcgttgcagttccataatatccggcaaccagcccgctgactcatgaatatgccaataatcaaccgtagcgcccaatgacttgggaatatcatacagctgctgataactcgggtacagtgcaatcacgtgatcgccgggttccaccaaactatagattgctaaatgattagccccggtcgccccatttgtttggagaacattggctgctggcacttgctcgtataactgactaacgagttctttaaatcgtggtgagccctcgatccagccataatccatccgggccgcccctagttcttcgtaaaaatcctgtggtgcttgttggtcgtctaaagccgcaatttctgccatcgttaaggctgcgattgagctttgactaatatcagtggttgcttcacgctcatgtgcatttaaccaggcctccactccgaaaccagcaatcttcatgcgtatcgtccctctcataaaaagtccaatacgactagcataccgattgtcagaggtaaccgcaactatattttcgtgatgaaggttgctagcaacttcacgccgtatagaataatgatgccaccacagattcgattgatccagagtaggactcgtggttgcatgagatgtttaaacttactgatcaagctggtcagaccgatgaaccaaatgatggatgctaggatgacccccaacataaagaaatgggtcagtgccgccgggattgacacccgaaacgccgccagcaacacggaaccatcaatcagtgcttgcggattcagccatgctaccgaaaaagcggtcagaatcgctgctttatatgaaaagtccgcgtcgagggtccccattgccgtggtcttttgccgcaacagattccagccaatgtaaaagaccaataaactcccaatcaacaacacccctaattcgagccagggagtggtctgcaacaatcggcccaccccataaaagcaagccagggaaagcgacgtatcgaacgcaattacaattaaagccacccgcaatgcccgttgcaatggttgttcaatagctgtcgaaaccacaaataagttttgcatcccgattggtgcaatgtaaacaattccaaataataatccttgtaaaaacacttgcatgttttgacctccttaagaccagccaattcgattcttttaccaaccaattatcgttcaatcaattggtcatatccgactagcttttaattcagagatgattataatagagataatttcatttgtagccaaccaatttaacaattttcatccaaccacctgaatcaatcatcaaatttctggctagtagaatgacagcttaattcgcccgcatgggcactcaggaggcgtttgccatggcaattttaacgatcaactggcaaccaaataaacaggtcagcacaccaatttaccaacaaattactaactattttcaagaacaaatcgcgaaaggcaattgggccgttggggctaagcttcctgcgcagcgtaaactggccgaacaattcggcgtgaatcgtagcaccctaattacggcacttgatgaactaatggcagtcggcttaattacgagcaatccaggctctgggatggttatttcaggtaaccattggtccagcttattggcggaacacgtcaactggtctcaatatgttaaagcaggccaattcaagcccaattcccacgcgctccaaaaaatcaaccaatttgaaaccgatgcggttattcgtttaagtacaggtgaacccgcaccagaacaatttccccgtccactttttcaacgggcctttgcacatctaggcgaacagttaacgagtttgaactataccgagcctgcgggcattttggctttgcgacaacaaattgcacgtcacttggaaaaagttgggattcatacccatccggaaaacattctgattacttccggatcattacaagcgctccaactggtctcaatgtcactatttcccaaagatgccaccatctacacggaagcacctacttatgtcaaatctttacacgtctttcaatcggcccacacccatctcgctggcatcccgatggacagtcagggcttggcgtactggcagatgaacgcccccattcagggacaccatgccattctttacacgattccgacattcaataacccgactggaatcgtcatgagtgccgagcgacgtcaacaggtcttacaaaccgcacaagaacaccgcttaccaatcttagaagacgccgcttatcaagatgtctggttcgatcagcagccgccacagccactgaaggcactcgataagactggcaacgttatttattttggtagcatctcaaagtcccttgcaccgggattacgcatcggctggacagtggccgccaaaccggtcatcgatcgcttgactgacgtgcgcatgcaaaccgattacggcgctagctcactgtcacaacttgtactggcagaaatcttagctgatcctgaatatgaaacgtatcaagctgatttccggtccgtacttgtcaagaaggccgcggcggcagaacaaattctgcatcattactgggacgattttgcgacttggcagacgcccacgggtggcttttatctgtgggtccgcttagccgacaacattaatattcccaaattattcgaccttgccactgcgcacaacgttctcttcaaccctggtagtatctacgatttccagccgaatcagtacattcgtctgagcttttcttatgaatccagcgaccgctttgaacaggggattaaaattctaactgatttaattcacgccaattttaacgtttaatcaagtaaagatttcgttaatacacctgattaaccatcatcgatgataaaactatgctagaatgaagactgaataattcacaataatgataaggggcgtattttgatcatggatgatgttaaagcaacggtactatcgatcttgcaagatttaactggggaagatgtttcaaacaatatggatgccaatttatttgatgaaggtatcttagattccatgggttccgtacaactgttactagaacttcaaaatcagcttggtattgaagtgcccgtttccgaatttgaacgttctgaatgggaaacgcctgctaaaatcgtagctaaggtcgctagtttacaataaataaaaattcaaatcgccgttaagtacgctgcttaatggcgattttttaattagctggaaaaattgtctaattaacaactgatttactgcaaataactttaatttgccgatttccgaattacccgtggcaccagcaataatggctatcacaactcattttggaaaattttacgaaaatgatatgcaaagtttacacaattttgataaacaaacgttcgctaactgagtaaactaaaatcactaaaatcatttttgtaagggatggtattttgaaaatcagtgttcatcagctcatctgggtcacgattggcgcaattagcttaactatttttaccggattcggacacctatttgcccggcaccaccaggctattgccagtaatcggccaatcactaaagttagtcattcagcaactaaggtaaccacgccagtcccggagaccgttgactggcacaagccctccctgtcacggccgtatcccaaactggctaaatacgatgacatcaacattcaggtttcaatcaaaaaacagcgaatctacttaaaaaaccacgatcagaccctttataccatgcttgcttctacgggcaaacatggctctgatacccccaaaggacactttgaaatccaagccgaacgaggacaacacttttttaacacgcaatcgggtgaaggcgccaattactgggtctcattcaaggatcatgggatttacctatttcactcagtcccagtcgatgctaacgatcaatacatcgttaaagaagcccagcaacttggtaaagtcgccaattcacatggttgtattcgcctgacgattgctgatgccaaatggctctatgaaaacatctcaacccatacaccggtggttgtcagttaatgaaaaaagaatttaggccacatcctaacgaccgccataatctactctgctatctcagcagcatgttaattaccttttttggcttctatagctttacttacctagtcacctggttaacgattgaaaagaccggtgatccccagttactcggcaacgtcatggcgatgacaatgctgccggcaatcggtctgaacctagtagctggtcgggtacttaaatactactcagccaaacaaatgatgttcattacggatattttgacgggaatactcttcattggtgcctattacgcactaaatacggttagttggcaaatcacttgcttaatttagtcatcgtcgccgttcttaataaatcaattggggtcttttataagctcagtaacaaaacgattttgccagacctttttgcgcccgtaaatattcaaatcgtcaacggctatcaaactcagattcgccagttggccatcgttagcgcgacaatgctcgtcacgatggcattactatgggtaacaccggctaccctaatcttaataatggggatagcgttcttggtttcagccggcctcgattggcaattccgaacacgttccaatctctcctcggattcggttgtcaccgtcaagctagaccgccatcgatcatggccgacatggtcgttactgtacgccgttctcggttatctggtcgacgcgacgattgcagtagccgttccttggctcgtcgtcagcaagttgcatagtcactggccacttagctggttcttaacagctaacgccacaggtatcttattggcaccactattgctaaaacgatggtcaaagcaatccctgctaactttgacggccttcaccggtgggtgcttactacttatgtggccgacctttgccagtcttatgattaccatgttcttaattggtgcattacgcggacagatcaacattagttttttcaccactatccaacaaatccccacaaacaatcgtaatattctaatgacgggggtcttaaccgtcatcgacaccactaccgttattggtagtttgctagcaccccgtttgatcttaatgctcggttcttggaccctccccttgcttggtggtggtatcctcttgttttgtttgacgcggctaattatcttattgaacaaccaaaagcagtcttcatccgatatcgacgaaaactgctgagcaacactcatttaatttgaggccgagggacccagatcttgaccattggatgcaatcactcgctgataccagtagaaagagtccttcggaattcgggccagagttccactaccatcgtcttgacgatccacataaatcaatccgtatcgtttagacatttgccctgtacctgcagaaactaaatcaatacagccccaactggtataaccaatcagtttgacgccatggtgaattgccgttgccattgcttgaatatgtttacgtagatagctaatccggtatacatcatggatttgaccatctactgtcaaataatccttggcacccaatccattttcaacaaccattagtggtaaatgatatcgatcattcatcagctccaaataatattgtagaccagccgggtcatccgcccactcccattcagagtattgtagatatgggttacgcgcgcccatcgaaaaattaccgccaacagttgcactgacctcatgtgttgtaactgccgttgacatgtaatacgaaaaggtataccagtcaaccgtaccggctttcaaggcttctaaatcactgtccgtaatgtctaaatcaacttgatgctcattccataaacgtcgtgcataggttggatactgtccctggcactgcacatcaccacagtaatagatgttttgttcccagacgtaccgattctgcaagacatccgccggatcacaggttaacggataagacgtgataccgcaaatcatgcaaccaactttattttcgccatcaatcgcatgtgcttgctgtacggctaaagcactagcgacaaattgataatgtaattgttgataagcgcgttggtaatctgcatcaccggctttggcacgcaatgccagaaacatgatcgtattattaatttcattgaaggtaatccagtgctttaccagcccacgatacgccgtaaatagcgtttccgcataatgctggtaaaaaccaatcatccgacggtcattccagccaccatacgtttcctccagatacagtggcatatcgaagtgtgaaatcgtcaccaatggttcaatttcatattttttcaaagtttcgaacacctggcgataaaaatccaaccctgcttgattaggttcattttcatcgccgcgtgggaaaatccgtgaccaggaaatcgacattcgatacattttgaaacccatctctgcaaacagcgcaacatcttcttgatatcgatgatagaagtcaatactagtctgattaggataatagtcatctggcagtaccgctccgtgtgctccagcaggaattgaatccccttttccaggagtaccatccgcttgcaaataagtgacttgccgtcgctgattaaggcctcccattgtcgtaatatccttcatagtcaggccccgaccatcaacatcataagcaccttcgcattgattagcggcagtagccccaccccagtaaaaatcagccggaaattgcatattcacacctctttctcaggcttcacaggttgcatgggcgcattaccttgattcgaaactgccgcccgcttttcttcagcttcaactgccgcctctttggcaatcagttgcttttcataaactttaaagaagggataccagataagcgctgacggaatcagcatcaaatagtcagtcaatgcgttgcgccaactgagcgtactgagataacttccaaaacccatgggtaaaatcgcggtaattacaatccaccccggtgttaaaaatccaatcttgtatagtacgagtgcacacaacataactaccggaatattcaggacaaacgggatactcataatcggattatacataattggaataccaaaagtcatgggttcattaattttgaaccagccggggataattgacagcttaccaacggcactcagctgtttagatttagaacgcatcgccattagcgctaacggcagggtattcccagttccacctgctacggtcataaatgagaacaacatcacaggtgcaaacaccaccggcttcccagctgcctgcaatgcggcattttcagaaaccgcttgaatcactaacggcatcacaattgggactaaaatcatcgtaccatgaatgccaaaggtccataataaagcacccaagatacacaggacaaaaatacctatggttgaagtcagtgcactcagtggaattgccagtaattccataaaacccgaacaaatattatacttaccggctgttccaaccgtgactaataacgatgcgcccaagaaaatcacggcgttaaacaataatggcacaatggatgcaaaaccgtcttggagaaattgggggactgcatctggcatgttgattcgaatattcttgtctgtacataatttctcaacgcggacggaaatccaaactacgacgaagccaataaacattccctgagcacctaaataggttgtatcaatgctaactgttccagtcttactgacaatcaacccaccggccacaatccaaaaaccaaataatgcgtcaatcgcattcatgattggggccgtcatttttaaattcttggcgtaatggaatcccaagaataaaacaacccaaattgataaagaattcattgagaattggaatggaatcttcaagtaggctaacagaatactctttgctgataacacgccaaacatcgtcggtccaagtactgacatcgtgatttgaaagatcgcgccaaccattagaatacccatcaaagacatcatagctgcctgtaatgcggtaataaacttattattgccaagtccctggccggcgcgttgtaagccgaccatcagtttactattaaaaaagcgttccatcgtccttcacccccgaatactaatccctcgtcatcacaccaagttctcggccagtttgaaaatatgggcactgtcacccaccgcatagtccaatggtggaatagcagcgacgggcaacccagttgccgcctcaacttcaccctgccgataagccacttgcggccccattaaaataacgtcatagtcctgatagacatcttcatacgcggacaagcctactgcctggatttgccctgcaacaccttgttcgtcacgatattgctgtaactttttcattaaaatgctggttgacataccgcccgcacaaactaataacacgttgattgccttcataaatcgaccatcctttcaaatttttgagacatctttaacatctcagcgattaactcgttagctaacagactcgtcataaaatgatcttgagcatgaattagtaaaatatcaatggaaacctgttgaccattcgcctcagccaccagtagttgggtttgaacatcatgtgctttccccagtgcttcactagattgcttcaataacatcttagattcggagaaagcatcgcgatgcatcgcatctaacgcattaaaagccagcgtacgaccttcaccagaatacgcgataagtgtcattgcaatatcttgagtttcagtattattggctaatgtcattatccggttacctactttctgtatttgtcgacaaacatatcgtaacaagttttgtcattaaccacaaaagcgcttacatatgcttgtgtatagatttaaggtccatgaattagcagtatcaacacacacgtggcgtcataatagctgaattagactaaatatccaacttcatcactattagtgtataggtttaatgaccaatttatgtattgtgtatagctgattcatcgggttgtatagcttactcattttaacgcgtttttttcagccttgaactgtcgaaaatgtctcgctataatcgaatcatgaaaatcattcgcacacttgccgtcacaaacacggaattttatgactggttagaaaaacaactactcatagagattcaagccgctactggtgaaatactcacagcaacgtcaatcaagaaaggactgacatatacaaaaacgaccgccaaaacggccgctcagattaaaattacgattgacgattatcagcgtgggattaagtaccaaatgacagctatttcaccactggataccgtaaccgtgacctattcgaccattgctgaaggcaccaaaacaaccgtgacctttctagaagatgttgacagttatcggccacaacaacaccattggctactcagaaattttagtcaagcactgctactcggacggatgtctgacaagttattgcaactcgaacaacaaatcattgctcaccgaacaacaacttgcaaaccgagccaaccatagatactttgtcaacggttaggcctttaaattcatacgaatcgctgaccatctaaatagtcgcttcaagcaatcgccactgcttgaagcgacttatttaagtctcatttaaaaactgctccgtcaatgctagaaccaaccatcatctccccatcaaaatcaaagctgacaccttcctgatatcaatctcaaacgattatccgtggcacttaagattagtgtaattgctttaagatgaccagtaacgtcccaatcatctcatcattcacaatcagtttaaatgtctgctcgaccggccgtagacaccgtcgtaattgctgataatcttgcgaatactgggtcactaatttccgcgtttgcgccgttgtcgtcacaatcttgccagccaaaatacggtcaatcatgctacccaagtgaacaaacaggccaatttgttgatcctcagttagttggtataaggttgtcaaatcatccatgagtggtggtaacacacgctgcaacttagcaacttctgcgtattcgaactgcgtcttaaaatactgatagatctgattataagtatcccagcgaccagcttccggccgaaacatcagcacttgatctaactgctgatgtgaatgttcaaaaattgctgccatcgaaataaacggaatgccgaataattgaggatcaaaggtgccgacaaatgcatgaatctgataaacctgttgtagtctaagtacggttgccaccaactcatcacgatgcccaattgccaacgctttgacgcgcatctgtaaccgtgaatattggtcaatataatcttttaattgcgcagcacccccctcacccgtatgacacagcgtaataatcaattcatcttttgttgtcttttcggcgttcagttggtttagatcgacttgcactagatgataaacatcgtccacgtccattacgcgcgcactctttcgagcagcatcgactccgactaaagtcactgggacttgaatcatccgaattttggtcgcgagttcgccttgaatggtcgtcaacatccatttgattgcccccatatcataaatgactagcacacctgcaccgcaatcaatctcgctgattttatgcttcagtgccttcatcaccatcgtgctatcggctgataagtcaacatcataagcataagtattgctgacagcgctgagcgtgttcgttgttcgcatcagggcctgggcagtccccattccttgcatgacgtaaagcacaaccgggtgatgacgcgtcactggtgattgtgcaactaaaaacgttgctaataaagcaacttcagccggtgaaatggtcaaatctagttttgtcgctaagacctgtgctaatttaacagcagcctcatattcggccacatgttgtgactgtaattgcgtgatcattgtcgctgatgcaggtttggtcgttggcatttggcgatacatcccattaatgtgtaaacataatccattaaacacactctcggtcaacggccgtgccaataaccgttcacaatctggttgccagtctttgacaatcttaataattagtggcgcaacgatttgtgctaaattttgcgtattggacgcacgctgttggacgatactcggttttatcactgacggtgattgttcaactgaccttggcacttggacactgcgaggacttgttcccggctcaacttgttgccgactcgcttgcaatgaatctgagctcaaacccgaagacgacttggccgcaaacgataaatcagctgctgccaacacggccgccaattcttgttgatagtcccgttcgtgcgctaacgcttgttgaacggcgggcgatagatccgcaaggtacacgcgaacttcacggtcagcatcagccataaatcggacataagcctgcgcacaggccatcgtgatggtcgctttcatcgttttcaaattctgatcataatttgccagcatgagcgcctgggcaacggctagttccaatcgaatcgtccgcttggattgttgagcttcaatcgtcaaaaaacgacgaatcaacgcccatctttctgaccacggtcgttgcttaaaatcaggtaattcaattttcattatcaattgctgcgtcctaagaatttcctgatcaatcccgctcactaaaatgattaacggtggttgcttatgggacgccacggcttccatgacactcgtcaattgtgcgcgttgcgggccatctaaatagtcgtaatggtcaatcacaacaataccgccctcggagtgtgcccaaagactgtgcgctagctggccatgctcaccaaataattgactatcaagttggtgaatatcgtctgcataatcacgacacttaacaatgatggggctgctagctgccgttaatataccccgttgctcaacaaaattctgaatttcgtgtacaaacgtggtactgcccgccccaccgtttgccacaatgtgaatattcaaaggaccactcggatacaaaacagccgcttttgctagtttgatcgcatgttgcaagctatttaaacgaccaattagtcccgtaaatggctcttggaggtgggacgcagctaataaaaattgaactggccgcgtcttagtcttgaccaatttttgtttgcgcactaaggcattcaaagccgcgctaacatttgtgcgttgcattttcaattgtgtagcaatgaccattgctgtcacaccatcgtgataccgcgtatccgttaaaaccaatttgcgtaccgtatcataaataagctctcgtgtcgtttccattagatttcccccacaaaattcgcatcactacatttataccagatttgtacatatttcgctgtgattggcatccgcaaaaaaagcacccgttgctcatcacagcgcgtgtcgttttgatcaataattagccataattacgccacaagtttggttaaaatttgcgtggcatccgccaaaactttttctgggtgctggcgggcgtcggtcaacatacccaatggctctaaattcattgcagcaaattctgcgtgccgagtttgaaattgacgatggaatgggagtaagtcactggccgtcatcgctgacctaacagctactggtgctggataacgattcaacacggtgtagattttaggattggtcagtgtgtattccatgctaaactgtaaggcccctaaatcttgatacaacaacgtgttgacatccgtttcagtcgaataggttaaaataatttgttgcgctaatggcaaccagcactcgttgagtaaccaagtatagttatcgtgtttcggacccgtagaatcaagatctatcaataaataatccgtctggacaccctgcaacgctatccaaaagttgttgagctcgttagccgttcgaatatctgactgccactcatggcagtgatgcttttgaatggtccgccacgtaacggtttgataattgcaactaacgatggtgaccgtcattttccaattagtcaatacgttcgctaacgccagtgtcaacaagctcttgccactagcaacctgcgttccaccaatgactagtgtctgtggttgtttcctcaaaacaaaaccctccttagcttaatttacaccaacagcatacccggacagtcgctgaattactagtgttttgcatgtataacaggggggactttgggctttttatgagaagtcactgataagtttgttggcgaattaattcactcgttgaataagtcaagtgggcgatggattaattctgcatagggttgacaagacacagttttggccataaaaagtaagcgccaacatgtatagcaatcaatttaaacggatacaattgaatttcaccattgctacttatcttctcaaaaattagtttttactaataatgtttagttatgtcaattaactaactagcacccggtttgtaaagaaccatcatcgacgtctcaagtacacgctaactgccaaataaccatccccagttacctacgaccagaagatattaatcaaaattagctcgactagtaatgcagaacctagccgagctaatttacttttctcaatcagaagtttctgcgtaccctgggcgagccaatattagaactggctgctgtcgttaataccagccctaatgaattaatgacccccacccctgaataaaacgactattttgcgacatcccgcacagtttttaaccactccttcaaacaagttgactggttagcataacttttccatcacgataattatccaatcacttgttattcagcggccaaggctttgatcggattagcccgcgcagcccgccttgctggtaaaatagccgcaagccaggcgataataattgcgattataaaaattgcaattacgttgctgagctgaatctgaactagcgcatacccgccagttagcttagccagaccatgatttagccctcgttcagctaaataggacagcccagtcgctaacgtggcactgataatgcctaacatcagcgcttcactagtaaatagccggcgaatatcacgccggcgctcccccaacgaccgcagaataccaatttctcgcatccgagcactgaccgacatgaacatcgttacaataatcattaatgcggaaacgattaatgaaatccccgcaatcgccgccaacactttagtggcaatattaacgtaagtattgaacgaatccaaagtggccgcaatactagtcgcggcaaatggatgcttgccattaattgataagtggttaatttcattgaccacgacctgattttgcacccgactcttaattctaacgctcacaaacgttggttgtgttgagacacgtgctgctgaacgcatcgactgcatcgtggtgtagttaactgcattcaaaccgacctcagaggtactatctactattccggcaaccgtcaacacacgcgccacggtcacgggttgccctttttgattgaaggtttgataactcacagtcacagcccgacccactaactgacgccaacgcgttgccgaccatttctgcgcgattgaagacttatctaatacgatttgattgtcacccgccacgtggcctgctttcaactgccgggtcgggtcactactcgtccaggtcgtcagttcaggtgcggcatacttttgttgtccaatcgcaatcgttgcgtttgtagctgaaatcccgggttccacgttggtcacgtgcttaaggtcacgcaacgctgtgagttgtgagtcggtgaacaccggcatccgggctgcgataccgccggctacagctggatcatagacggccgcagcttgttcatcacgatccttcgcgttatccgcttggtgcatgaccataattgattgtgggtccaccaacgcattcatttcgtggttaatatacccttttatgccggttcccagaccattgaaaagcatgacggcgaataatccaatcgctgtgccaacgacaattagcgtattccagatccacgtatgccgcatatgcttgaaggccatcatgactgatacccaatacgaaagtggccgcgcaggtagtgacgcaactgtttgcgtggtgccgtcattttgggtggtcactggttgtgacttaattcgtccattcaccaactcggcaatccgggtcgccgcacccgccacgcgctgtgaatgggtcacacaaatcaccaagcgcccttcccgtgcgattttttgaagcatggccatgacatcggcggtattgtctgcatccagcgcaccagtcggctcatccgcaatcaaaattttaggatcaccggctaatgcccgagcgattgccacccgttgtttttgaccacctgataattgttgcgggtatttttttatttgtgccgtcaagccaacgtttgctaggagctcgtgtgcccgccgcaatcggtcaccatggcttaatttagtcatatctaaggctagcatgacattctcaagcacggtcaaatgaccgattagattgtaggtctgtgagatatagccaatgacttcgcgccggtactgatccagctggcgctcatgatgataatcaagtggttgtccagcgatactgacggttcccgtgaaatcatggtctagtcctccaataatattcatcaaggttgtcttaccaccacctgattcaccgacaatcgccacaaactcaccgagttcaaactgcaagttaatgtccttcaagacgttgaatgtttgtttgccaacctgatagttcttacaaatatttgttagttctaagtagctcatcaccaagcccccaatatggcattttgaattagttttcagaataccaccccgaacgactaaacaggtcattaaaattttagtattggaagttgccttattaagattttaatgtttgtttcgatcatcacaccgacttataatcagacataaatcatgcttggtttcactaactcggatgggcggtcatttgtaagcatcacgacgcctgcaacccagtttgatcatttatctgaataaaacacaggcaaacctcaaacggagggataaccatgaaaaagacttttagcttaattggttccgactatattcgttgcgcgatttttttcgtgattgctttttatgccgtcaccgcagaccccagcggccattttcacctacattggacgttaaccaacctctatctgacttccgcatacttcttcggccatccactcctaatgtgcctattgccacgacttgcccataacccctttcaaatgatttcagtcgcttcacgtgccctgaatgatgcgaccggtcaacatcaaacaatcactcaaatttatcataacgccgtcaatcccgtcagtagccgtgatatgttgctctctcaaaatgaatatcgtgacgatatgatatcgatcagtgtttcctttgtcattcatggttgcctattgttactatcttggccgttgatcgggatcattttactcggccggggcggtaaagccttgatccgtcgactgataatccacttcacacgataagtctggttccagttacaatagtgggcctccgctacctacttgcgatttctgcgattggttcacaacttgcgttcgccatcggatgtatatcgagttccgtgcctctacggccgcaacaaaaaaacgccacgcattctcgcccggctttaacggccggtttagtatgcgtggcgttcaaatttgaacagttgttaattaattctaattacatttcatcgggagccttaacgccaagtaagcgaagggcttccttcaggacgatgctgacactcttgaccaaagccagacgagcgtttaattcatcatcttcaactaagattttggtgttagcataatacttgttgtatgccttggctaagtggatcgcatacttagcaataacggatggttcgtattccgtgctggcacgtactacagtcgctgggaattcactcaataacttcaaggtatcccaagcggctgggtcgcttaacgtttgctcggttgccgcaatttctgggctaccagctttacgtaagatactttcagcgcgtgcatgggcgtactgcacgtatggcccagtctcaccctcgaaacgaacaacttcttccaagttaaagtcaaaactgttcatccgttcgttcttcaaatcatggaagaccacagcgccaatcccaaccgcatccgcaacttcatccttgttaggcaagtccggattcttggcttcgatttgttcatgagctaacgcaaccgcatcgtccaagaccttatcaagcaggatgacccggccactccgagttgacaacttcttaccaccagaagtaatcaaaccaaatggaatgtggtggatctggtcagcccagtcaaagcccatctcggtcaacacagcctttaattgcttaaagtggttggtctgttcattcccaacgacgtagagggactgcacgaaatcataagtccgtttccggtagatcgcagcggccaagtcccgcgtgatgtacaaggtcgcgccatctgattttttaatcaatgccggattcaagtcatatttgcttaagtccaccacttcggcgccttgactttcttgcaagaggtgcttgtcttccaagatgtcgacaacttcttgcatcttatcattgtagaaggcctcacccttgaaggaatcaaagtcgatatccaagcgttggtaaatcttcttgaacgctttcaatgattctgagcggaaccatgaccacagatgggtggcttcttcatcaccattttccaattttttgaaccattcacgcgcctcgtcatccatttcaggatgatcgacgtcttctttatggaaacgtacatagtattttaataagttattgattggatcagccttgacctcagcttcgcttccccacattttgtaggccgtgatcaacttaccgaactgcgtgccccagtcacctaagtggttgatcttaacgggttggtaatccaacttacttaaaatatttgccaaagaattcccaatcactgttgaccgcaaatgccccattgagattggtttggcaatgtttggcgatgacatatcgatgggaacttgacccgcttcaccgagcttagcatcaccaaaatggccaccattcgacaacacttgatttaaaatatcggctgcaaacgcatccttcttgaagaagaagttaacgtacgggcccattgcaacaactttttcaaagtcactgctatcgactttttcgacgatgtcgctggcaatcatttgaggtgccttgtgtaacgttttggctaaggtgaaggtcggaaaggccaagtccccctgcttagacgtctttggttgttcgatcttgtctagaatcgcttcctgcgttaaatctggtagtgctggcgctaaggccgctgcgacgagttgtttataatccatattgtcctccttgattgtcttacgggacaaaaaaagtccctcacatatttaaaaacatgtaagagacgagacgtgcccgcggtaccactctaattgatatgacatccacttattatcgaattgtcgtcttcaaaagcgcgcttccaataatgtttagattcggctcccatcatcccgaactcgctggtctaaacgttcatcgtactattctttctcattagacgtatatatttttaccatgcgttagtataacagaattcagccgttttgactagttcaacgttaaaatcatattctgatgcggaatcccatcttctaaataaacgccagagactggttgaaaaccaaatccacggtagaagcgatctaagtaatgctgggcctgaatattgatttgcgtcgtggaaggccacaacgcttgaatctgcacaatcgcctgttggagcaactgctgaccgtagccgtgcccccgcaccgccggattagtgatcacccggccgatacgggcctgctggttggcttcacgcattaatcgcgcatatactagcagctgtcccgttgaatccagcccccgtaaatgccaagccatcaagtccgtatcgtcgacttcttgatacggacaggcctgttcgacgacaaaaaccgccactcgtaacttgtaaatctgttgtaactgctgaacagttaactcatcgaaagatgttgttataaattgcatttgcgctccttaacgattactgttgatcacccattcggtcaactatttagtcatcttgattttttactcaataaaaaagaacgggtcattgctgactaacgttcttgattatcatcatctattaacggtccgtacgagactcgaactcgtgatctcctgcgtgacaggcaggcgtcctaaaccaactagaccaacggaccatgcgctcaaggagcttgagaatacaatgactactaaccgaaatgattaatagcaaagcgggtgacgggaatcggacccgcgacgcaagcttgggaagcttgaattttaccactaaactacacccgcatttgacaacagaaattagtatagcatacattttttctgttgtcatggttatttataaatttttaatcttctttttctgggacgactttcggctttggagccgctttaatgagcttagcatcatccttacgaacaactgcgcggtggttatactcgttaacaattggttcgtcagctttttgaaattccttaattaagatcaagactgaattttcatacactttttcaatttcacccttgaaatcatgttccaatgaagcaaacttcttaccagcgacgtaatcgccaatttttaattctacggccatttgtaaactccttaacgtttttcaattcatgccccgtccacaggtgtccgggagattatatgagtgactttaaaataaaattgataacaaatactatcaaataatccacttggttgcaagccttaattacaatttttccgaatcgtttaatattggttcggccccttctgcgaccgtgtttgtcatgcgggcctgttgtcgtaaatcgtggactgatttaatataagcaggcaaaagcacggcacacgaccctaaccaagctaacggttccgaactacaagcaccggcgtaatcgaagatccgaactaagatcagcgctgcaaacacccgcataaagagttccgccgcgcctgccaaagttggaattgcgctgcgtccaagcccttgcaaggtattacgcataataaataacattgataataagatatacgtgctcccgatgacgttaaaatacgtctgggataagttcaataccgccatgtcctgatgaccgacgaagaaccccacaagctgtttaccccaaataatttcaatcaaaccggcagccacactaaagctccccgacagccacatggtctgtttgactcccgtgataatccgttcatactgatgagcaccataattctgagccgcgaaagtcgccatggtgaccccaaaagacattaatggctgagtcgcgacttggtcgattttctgagcggcagtcgtcgccgccactgaattagtgccaagactattcagtgccgcttgtaacacaatcgttccaatcgcaatgatcgacatctgaaaagccatgggtaacccaacattcaggtgagccttcacttccgaccaaactaacttgaagtggcgccgtccaatgtgcaagatgggtactttgacgatgatgtaaaccacacacatgagcgttgcaatggtttgtgctaaaatggttgcccagctcgccccggcaatgccccatttgaaaaccaaaatgaataacaattccaagccaatattaattaacgcgctgataatcaaaaaccataaaggtgtgcgactatcaccgagtgcgcgaatgatgtttgacaacaggttgaacgcaattggtgccagcatcccgccaagcataatttgtaagaatgtccgcgcatccgcaatgatatccgttggcgtttgcattaacaacaagatatggtcaacgaagatcaacgacagaatcgtcaaaatgattccaacaattagactaactacgatactaatcgcaaaactgcgccgcactgctttaaaatcacgtgccccaaaatgttgggctgttaatatggataagccagcggttaacccctgcgcaaagccaatgatcaaaaactgaacactcccagttgatccaaccgccgctagggctttaacccctaacgtctgaccaacgatcaacgtgtccgataaactataaaattgctgaaaaatgttaccgattagtaacggaatcgtaaaccaaaaaattaattttagcggttttccctttgttaaatcgttcattttcgcactcctttcattaattaagatgacgtacttgtaatcgttttcttggcgctttgccagacaagcaaactttgctagtatatcaactttagatttataatactagtcctttgttcgcgaatattaaatattttattttaattagtgaattggccgtcttgatttactttttaaggttatttcactgtgctaagctgtcaccgatttactaaccaacaaaaaaaacttgtcagcaggcgctcacaagtcttttagattcgattaagtcacatcacagcaccatataatagtaataggacacaaacacacaaacgaccatacaaatcaaatttaacggaattccgactttaaagtagtccgtgaacttataatgtccagggccgtaaacaatcaagtttgtttggtacccgattggcgttgaaaagtctgccgtcgcagcaatcgtaatcaacatcacaagcatcatcacgggtagattttccaacttcgctgcggaaacgaccactggaaacatcaatgataacgccgccgcattggacaagatggccgttaagaaattggtcacgaaataaatcaggaacatatagatgattggtgacgcattcccggtaattgctaccaatgacttcgcgataaacttatcagcacccacgttcgacatcgcaagcccaagtccataactactagccactaaaaacaacacgttcatatcgacagccttcacaatatcgctgattgaaacgcatttcgtcaagaaaagtaccacgcacgaggccgccagaccaacgaacaaatcaatcacgcccatagtcgacacgatgatcgttgcaaccaataaaacaatcggtaaaacatccttataagtatgtttccgggacttcactggttgtgaattaaagacgtgtaaatctttgagacttgccagctcgtctggttcaccagtggtaatcatgaccaagttgtccccgccttttaagcgaatacttccgagatgcccttcgaggttgacatcgttgcgtcgaattgcgacgacgacactcccaaagacattgcgaaaacgcgctgatttgaccgtttggttcaccaaactggacgtttccggaatggagacttcgacgagccgaacccgttcattggtgatatcagtcatattgattttctgagtgcttggtattagacctttaatattcataagatcattaatacaatcaaaatttccagtgaagtaaagacggtcacctaactgtagaatcgtctcatccgtcaccggcacgatcgactgaccactccgattaatcgccactaagaaagagcgcggtaaattacgaagtttggcggcgaccaccgtttgattgaggtgttcaaactcatcgccgatcgtcatttcaatcaagtaatcattcggttcagcaacaacatcgtcaacactactcccataataggtcggtaacatgcggtacccgatcgtcagtaagtaaatcaacccaataatcgtgatgggaatcccgatgacggccaagtcaaaggtaccaaattgtgctaatttgtacttagacaataatccttgtgccactagattggtcgaagtccctagaacggtcaacaacccactcagaatcgtggcgtaggatagtgggatcaagaactttgagattgccatccctttctgcttcgtccaacgctggaccatcggtgtcaaagtggacacaatcggggtattattcataaacggtgaaatcacactcacgctcgctaacaaccgtaataaggaacgcttttcgctgtgaccatcgccgagaatccggtcaaataagtgggtaataatattacttttggcgatggcataggcaataatatacatcagggcaattgtcgctaacccgtcgttagcaaaacctgacagtgcgtccgttggcgacaagatgccgacaaacatcaagaacgctaaggcacacaagattacggcgttcggggtcgtaacttccatggccattaatataaatgatactaataacgtgattaaaacaattgcaatatttaaggtcatcgtcatcgctccgcttcaactaattttcatcttgctgagtcttgcgccactgctcataatcaacctatatccgtcgcgccgttcaacataagaaccattgtagacttggaatgtgaacataaatgcgacatggtatgaaattattctagctttgcggatgattttgcgaccaaattgtgactttttcattaacgttcagtcacaactttgaaaacgaccttttcggactagcaattggtttgtgaacaggcacggttgaggtcagattgaagtcagacggacgctccaaagctggattgtcaaggggaaaaacaatgcctgactgtctctctataatctgttaacggccgtgactgattagcgcaacacgcaaacaggcgcccccgaccagatgagccatctagtcatgagcgcccgttttacattcaattcttattcattaataccatacgtgtgtttcgtcggatacaacgagaagcgttcggcccggtagacataaccaccgcttggaaggcccgttaattcaacgttaaacacctgttgcttgctcttcaaatcgtattcaataatattagctgatttaccattattcaaccaaccaaaatcaattagccgattcgaagcactcaagtaacgattagaaccaataatattggcaaagttcttcttacctaatgacttgccgtaactgccaacttgagaaatcgtcttcgtcttttcattaatatgatattcgacaccttctgaatatttaccagaagagtccgccaacgatttcttggtcgtaccaactgccacgttattgttgaagatcatcacgttgagcgagttcttattgcccaaggtgcttggatcaacgatggcggcatgttgcccacccggccaagcaatcttaccactagccttcagcaagtacttgcggtacgatttcggccaagctgaagtcttcttaccagacaagatccacttgatcttttcagtcttgtaatcgatcttcatcactaagttctggttgcgacttgaaataatcaagctcttatccgtcttatcataatagacggagttctgatggaaccagtccttcttacccatatatttactggacttcgtcgcgttgtacttcgtatagaacttcgcaggtaggatattcttcatgttgatgaccttggtgatcttacccgtcttatgcgatataacgatcatcgtgtcttcgacataggtccggccgccatcggaaacggtcgcaatcagatcaccgtttggtaattccgttacgtcatggtggacctgattatggttctgcttcttagaacccttagccttaccccaggccttatgattaaatttataagtcttataaactttacccgtataatccatttcaactaactcatcaaaatatgaattcttagcattcgatttggtccaaatcaataaatgcccattgttaagttgtttgaaaatgtgggaagttggccgcgttgtataccaccgaatattaccatccgcatccatcccgaacgataagtttttagactgcttgctcccagagatcgtcgtccgaaccataaatgtcagcttcgaattaccagtccctaagaccattttttgtttgttagccttcttaacgttgatcttaaaatcggtcaacgccgatggtaacttcgccgttttcagtcggatcgtcttggtcgtcgacgtgccatccttataagtcaccttaatcttgacctggttattcgtgttggcgtataaccccagcacggtcaaatcatgactcgttgtgtacttattgaccgtattagaaattgaagtcttactactcttgccgaccaccgtataactgaccttggccgccttgctcgtctggaaaatcaccttagcggataacggagacaccccatatgggttaaccttcgtgtacatgttattaacggtataattcttattggcgaccgccttcttcagcgtcgccgtctcactcgactgggccttaatctcagtcttgactagccgcgtgttgatgtccttcttcgttgcactcgccgaacgtaccttactagtggtcgttgtcgttgcagttgactgatgatatttgtaatacccaaaaccaccgccaatcgcgacaatcacaacgacaattagtgcaatcaaccaatttcgctttttcatttacctttcaccgaccctatctcactattttttctgacgccaattaattcctcacgactgctactccaacggcatgcccattttgtcagccagaatattaggctcacgccgctgatactggcggtctaaccttcccgtggcaacccacgtgaccgacacagaatgactaacaattgccatgccgaaccgaatcagttcagtttatattaaatttattatacttaatctacggccgtcgcagccaatacttgcgcctgcatttgctcaatgacttgtccaactgtcactagatccgggacaaatgccccacttgctaacggatgaccgccgccattgaacgcttttgcgaccgcattgacattgattgctttcgaccgaaaatgtacgcggtattgcccctgtggggtttcaatgaagaacaaccaaactttgaccgtcgtcaggttaccgggcaacgggacaagcgcatcctcatcgccatattccagactcaagtcactaaatatccgttgtggtaagacaacgtgtgccagaccacttggctcaatagtttgttcactcaggacgtacccatacaacttgctgagtgctggcgttaagtccatttcgtggtgactaatagtggcaatatcaatgtccgttgccgcgagtgcactagcaatcttcagagttcgagtggacgtctcgggagttgaaaagcgcaccgtatcgccgataattccggcatatagcttggttgcaacggccgccgtcactgtaaaacaccccgcttgcgccaactcataaatcatctccgagcaactgctataagtttcatcgacccagttcagttgcccatagggatcgtgattcgggtgatggtcgattttaatcacaaaggcacctgttggcaactccccagctaggcgctcatggttagcacaatctacggcaatgactaagtccgttgcttggggggtcactaactgctcatcggttgtatcgatccacgccaaatggcccggaactggggccatcgccacaacaagtttctccgggtaagccgctttgagcaaggcgactagtccaaattgtgccccgattgcatcgggatccggattcgtatgacgatagaccaagattcggtccattttcacaatcgattttgtgatgtcagtaatgattgcattagttttcatttgcagtaaccaaactgacataatggtgttccgccaagtaattcaatacttgttggacggaagcggtcagtggttgtttggacgtgtcaatcgtaatctcaggatcgataggtgcttcgtatggtgcatcgatgcctgtaaagcccgtgatttcaccacgacgcgccttcgcgtacaattgtttcacatctcgttgttcacaaacttcaagcggcgtgtcgacgaacacttcaataaactcatcgacctcaaggttcgcccgcactttatcacggtcggcccgatatggtgaaatgaaagccgtcaacgtaatcacgccagcatcgacaaatagtttggcaacttcgccgattcggcgaatattttcttcacggtcttcagctgagaagcctaaattcttattcaagccaaaacgcatattgtcgccgtctaaaacgtaactaccaacttgttggtcaaataatgctttttcaacggcattcgcaatcgtcgacttaccggagccggacaggccagtaaaccataaaaccacactcttatgatggttcagcgcttgccgttcggccttgctaacttgcgattgatgccaagtaatattatctgattttaccatgcttagacctcctgttgctgttcacgtttacgcttcaacccatcaatgagaacccgggcaacttcgggacgtgaaacttcctttggtggtacaacaccatcagccagcatcttacgcaccttcgtcccgcttaatgagatgtgatcttcggcaccgtgtggacaagtcttctgcgttgccattgaaccacactttttgcagtagaaggaattatcgaatttgaagaagtgcatgcccatctcatcttcgaccgaagtgattaattcttgggcttcataggtcccgtaatagtcacccacaccagcatggtcacgaccgacgataaaatcagtacaaccatagtttttacgaacgattgcgtgtaagatggcttccttagggccagcataccgcatcgcggctggataaatgaccaaccgaacacggtcttctggatagtaatacttcagaatcgtcttataactttccatccgaacatctgctggaatatcatccgccttggtctcaccaaccaatggatttaagaataacccatcgacgttttccaaagctaatttttgaatatattcatgcgcccgatgaattggattccgtgtctggaacccaacaatccgcttccagccgaggtcatgaaacatcttccgagtttctaatggttccatataataatcactaaaagcaccatgatctggcttatgcaacaatttaattgcgccacccaagtagacgtcaccattggcatacaagcgtttaacacctggatgggcttcgtcggtggtcttgtagacgttttgggcttccaattgcttgtccggaacaaacttatcttcaacttgcatcgtgccataaatgacgccatcagcgcccctcaaagcaatcttagtattcaattcaatcttatcagcatccgcttgggacacacccagcgtaattggtacactccagataacgccactcttcaagtgcatcgtgttgaccactgaatggtaatcatcactgaccatgaagccagtcagggggctaaaaccaccaatcccaattaattccaagtctgagatattccaattattgatggttaaacttggcagctgctcagcagcctgacgcgttgcttcactaaaatcttctaaattaactaacttaccaccatgagctttaattccgtacactgtttgcatattgatcacctttcacgtttaaaatttcatcataattaagacttacaaaatggttcaatgcggcttgttgttgctcatcctgactcgcacgtcgacacaacgctgttaaagttgccgccacctcatccatgtctagcggggtccgcagcttgaacgtttcgtccggctgttcgtctcgtaatggtgctgccttagtcggttcagcagcaataaaagccgtcaccgcactttgcgacgcaggggttcccagttcgtcagccatcaggaccaagtatggtggctgttcaaccgcgtgcaacgtccgtactaaatgttgaatcgctaatcggcgctcacgttcatcaatgatggctgttaagtcatctgcaatcaccacgttgtgcgtatccgcacctaactcggcactgaccgtcgttaacatttcaacgatttcattgtttttagcatccccaatcccccataacgtctcgcgtttcgcgtttttacggagataattattcagggcttccttttgctcgaccactaaatagtccaaggggtacgtctgaatggcaatcgtattattattcaaccgttcgctcaaatcttcagcaacctcatgactgtcagcttctgtgccgaccatcttgacttgaccatttcgtaaagtcgtgttgacctgatcaacttgggcctgatcttcgccgaatacaaagaacgttttgctattgatcttgacgttaaagtcccgatataaagcgccatacttggctaaatactcgtcagtcatctcgtcgatgcgctgttgaaattcagccgaggcaaagtaatccgggtcagccgcagcttgacggcctagtaagtaaagtgccttaacatcgggttccacgtccgttcgagcttcaaaatcagctaaattttcaccgctatcactcttttggagtgctggatcgatgaagtcatcgatttgcgcttggagggccgcctcgtcgctcgtccacggtaagttaaattgggtcgcgattcgtttcaacgtcgtcaacgtctgaccaaacaaatcttcgtacgtgactaaaatgcggtgctcacggtcggtatcacgtaatgaaagcaacgtccggacttgccactgacgcattgcgagcgtggtatcgcggtgccaggcgcgctcattcgaattgaccacgtccatcggattacgtagcaagacgatttcagccggctgaacctcaacgtcagccaaaacacgttgccacaattcaatataatcattcatccgtgggtctttaatcgccagatattgttcattctcaaaaaagtttcgtagatacgtggttaacgccgcccggtcctttttaatcttcgggctatcatagtaacccttgaaggctggccggtaccggatgcgacttccaagtgacttgtgaatattgatgacatctttattttcaaaatagcctttcggattgatccgcttactaggtgccagcaggttatcagtcccgagagaaatgcccatcaaattaacacacttagtcattaccgatgttccggaacggccactcccaagaattaatacggcctgcttcgtttgttgacggtgattaaacaatcgttgccataagctttgactcattcttcatcatcctaatcattattatttattcgatctttggtgcttcgctagtgggctcaccaaatatactagcaagttaattgtgaaaataagtacccttaactcgaaaaaaatatgatgatttcatgaaatttagtgcttttagcaagtacgcacccggtaatctgctgggtgtagattaggacatttccccacagttttgatgaaatattcaaattttaggactattaaaatccctttataccagtgcattgattaccaaagcacctgatttcactcaatatcgtcagcacccttaaccaacttaatcctcaattgaatgcttggcgcaacgcccctgttatgaaggcctaaaatgtcaacccaaccatgtgggagctgcgtttcaaccctattcaccagctcaagtggtcgaaatccgacaacggttgctggcaaagactagtggctgttcacactacgtttcctacttgcctggctccaaatagcgtgtgcgtcacattacgccttgaatatgtgcaaaaaattaaaaaatgatttgactaaattagaaattggtggtattttctaatcaatcataaaacatgtaaacgtcctgaagaggaaagtaatcatcgctacccgtgcagtgagtttggaatagtgcaaaccaaaccggaagacgattgatgaaaaatggcctccaaacggcaccactgagcttttgccaggtgatgacagttagctactgttaataagcttccgtatgaaacgtacggattgaggtcaatatcgtgaggtgttgacaaattaaggtggtaccgcgaacggcaacttcgtcctttaatcaggatgaggttgccgttttttcgtttaaaataatttgctaaatataaggagtgggttttaatgacaattattaatagtaacttggggtatccacgtttaggtgaacatcgtgaatggaagcacttattggaacacttttggaaaggacaattagacaacgtgacctttcacgccactgctaaaaaattacgtctagctaacttgaaaaagcaacgcgacctgggagtggactatattccggtcgctgacaattcggattacgatcacgttttagatacactagtcgcattcaacgcgattccaagtcgctttggtcacttcgatcaccagttggacttgcccgactactatgcaattgcccgtggaactgataccgccgtggcggccgaaatgacaaagtggttcaatatcaactatcactacattgttcctgaattcgatgacgtatcctttaagttattagataatcgctggctacgctactaccaagaagctaagcaagaactaggcattgatggtaaaccagtcattctgggtcccatctctttccttaaactgggtaaacgtcacggacagtacttggatgacgccgccgtcaacgaactattaccgcagttattaccgctttaccaacaagtgtttgaagaattagcgacagctggcgcaaaatggattcaattggatgagccgaccctagtcaaaacaacgacggttgcggaactcgcaccttatcaaactgcacttgaacatttgcatgcggctgtcccatcattaaaaatcgaactccaaacttattttgacagccttgatcagtacgaccaaatcgtgacctggccaatccaagcacttggactggacctagtacacgaccatggtgaaaacctggcgcacttggtcgaccacggcttcccaaccgacaaaattctcgcagctggcattattgatggacataacgtctgggctagtgatctacaagcaaaacttgcattagttcagcagttacggcaaatcgtgaccgatgatcagttatggctccaacccgccaactcattattacacgttcccattaccaccaaaaatgaaaccaaggctgaccccgtcttactgggcggcctggcctttgcggaccagaaattggcagaactgcataccttaaccgtggcagccaatcagggggttgccgctgttcaagcagtgttcgaccataatcaggccaacttgactgccctcaaccagtccagtcaccgcaacaaccagtcggttcgcgccgctgaagcgcaactgagtaatcaaaaattcgaacgccaggcgccatttgcgacccggattaagttacagcacgaccggttacacctacccctcctgccaacaacaacgattgggagctttccgcaaagtgcgcaagtccgagcaaagcgagcagcatggcgcaagggtaatttaaccgatgccgattaccaggcattcctgcatgctgaaaccaaacgatggatcaagctgcaagaagacctcggcctcgacgtcctggttcacggtgaatttgaacgcactgacatggtcgaatactttggtcaaaaactgactggcttctatgcgacccaaaatggttgggtccaatcatacggttcacgaggcgtccggccacccgttatctttggggatgtcgcttacacggaaccaatcaccgttgctgagtccgtttacgcgcaaagtctaaccgaccagccggttaaaggcatgttgacagcaccactgaccattatcaactggagttttgttcgcgacgatatccctagggcgcaggttcaaaatcagattgctttggccctccggcaagaagttcaaaacttggaaaaagctggtattaagattattcaagttgatgaaccagcacttagggaaggtttgccactcaagcagcgccattggcaaacctatttggatgaagcagtgtactcatttaagatcaccacgaccggcgtgcaaaacgacactcagattcatacccatatgtgctactctaactttgccgatatcatcgataccatcaaagcccttgacgcagatgtcatttcgattgaaacgtcccgtagccatggggagattatcagtgcttttgaacaaaccgggtacgatcaagaaatcggtctgggggtctatgacattcacagtccacgcgtaccgagtgttgcggaaattgaagccaacatccaacgcgcattacgcgttatcgacgcccggcaattctggatcaatcctgactgtggtctcaaaacccggcaagaatcagaaaccctagcagccttaaagaacatgattgctgcgcgcaacgcaatccaggcccaactgaccactagcatccactaaggaggtggcttgaatgaagtttaaacaagcactccagcaacgggtcctcgttgccgatggcgcaatgggcacccttttatatggtaactatggcatcaattcggcttttgaaaacctgaatttgacgcatcccgacacgattttacgcgttcaccgatcgtacattcgggctggtgccgatattattcaaaccaacacctacgctgcgagccgcctaaagttgacccggtatgatttacaagaccaagtcaccaccatcaatcaggccgctgtgaaaattgcagcgaccgcacgggaacacgcggatcaccccgtttacattctgggaacgatcggtggactagccggcgataccgatgcaactgttcaacgggcgacaccagcaacgattgctgccagcgtgactgaacaacttaccgcccttctagccaccaaccagttagatggcatcttgctcgaaacatattatgatttgccagaactactcgccgcgttaaaaatcgtgaaggcccatactgacttgcccgtcatcacgaatgtttcaatgttagcccccggcgtcttacgaaacggtacgagcttcactgatgccatcgtccaactcaacgctgccggcgccgacgtaatcggcacgaactgtcgcctgggaccttactatttagctcagtcatttgaaaacttggcgattccagctaacgtcaaactagccgtttacccaaacgctggcttgcctggcactgatcaggacggtgcggtggtctacgatggtaaaccaagctatttcgaagaatatgccgaacgttttcgtcagctcggtctgaacattattggtggttgttgtgggaccacacctttgcataccagcgcaaccgtccgcggtctaagtaatcgcagcatcgttgctcatgaccagccggctacaaaaccacagccaccaacgctcgtcacgacaaagagtcagcaccggtttctgcaaaaagttgcgacccaaaaaacggcgttagtcgaactcgatccaccccgcgattttgatacgactaaatttttccggggtgctgaacgattaaaagccgctggtgtcgatggcattacactgtctgacaattcgttagcaacggtccggattgctaatacgacgattgcggcgcagctcaagttgaactacggcatcacgccgatcgtgcacttgacgacccgcgaccacaatctaatcggcttacaatcagagatcatgggtctacacagcctgggtattgaggacatcttagctatcactggcgatccggccaaactcggtgattttccgggagccacttcggtcagcgatgtgcgctccgttgaactgatgaagttgatcaagcaattcaatagcggcatcggaccaacgggtaagtcgcttaaagaagccagtgactttcgggtcgcaggcgcctttaatcctaacgcttatcgcacttccatatcgaccaagtcaatcagtcggaagttaagttatggttgtgactacattatcacccaacccgtgtatgatcttgcaaatgttgacgctttggcggatgctctagcggctaatcacgtgaacgtgccagtgttcattggtgttatgccactcgtctcacggcgtaatgctgaattcctacaccatgaagtccatggcattcggattccagaacctatcttgacacgcatggcagaagccgaacaaaccggaaacgaacgggcagtgggcattgccattgcaaaggaattgattgatggtatctgtgcgcgcttcaacggcgttcacatcgtcacaccgttcaaccgctttaaaacggtcattgaattagtcgattacatccaacagaaaaacttaattaaagtacaataaaagaaaccgccgccaacacctactttcatgctaaaattagacatgaattgtaaatgtggaggcggttttgtcatgtacttattagggcacattattggttggctatggctcatgctgacggttgcgattggtctcagtcgtcactcagtcaaatcagccaatcgctttttgattcttagtcgcatcgggtacctgctaattatcatcactggggtggccttggcaatcagaaccttatcaggcaactggtggttgaccttgctaaaagtgatactcggtcttggcacgattggcctcattgaagtggcctttgcccgcaagcaggaaagtcatttgaactctggacttgtcaccctactcgtctgcggcaccttactaacgattatttgtggcattggcttgcactggcaattgacgggaaacttgatttaaaccatcaatgtcgttgaaattactgcctaacgatccaaagtgatgctatcaaaaaaaacaagtcgtccgttaggggacgacttgcttgcctgatgccaattaattgttacgatcactcaaacgtttcatgatttgctggcgcattcgcattttctggttgctttccataaaaatcagccgcgacgtcccatagttaaagagtcccacgagaacctggtcgatgattttaacaagtaggggtgcccagaacaacaacgaaatgccgacgaacatgaggaaagtatcgaaaaaatatgataagcctcgtgtcaacatgaaactaatgaactcgcgacaccagtgccaaaagtcttgcgatttggactgaaagaccaccgctttgttggtaaaaaaactaaacaaagttgctagcacccatgcgattgtgttggaaaataaatagtgttccgccaagactgagtgtagcacccagaataccaagacgttcaccagcgcggccataaagccaaacagtgcgtatttccaaaaatattgatattgatggtagattttaatcaaccactgcacgccgttcgccaccgtttcttctagctcaaaaatattatacaatagcaatatcataccttgttatcggccccctgacaagctcagccgttaaattggcgcttagtgggctggtcgcttatacttaaactaatctgcaattctttttggagtgaattatttatgagaacttatttatttattgccgggctgatcttagcctgtctaattttaatcattatcttaattgcggtgttagtccatctccaccatgtcaatcaggcggcggataaacaggccgcgttgcttaaatcaattcggcagcgcctcgttcatcaaactttgaccaatcaggaacaagaccgtcaaattaccaagttgcagactcaaaataacggttttcggaatcgcttgaatcaagccgttccccatccggtggcggttcctcagacgcgccggatcaacgctaattcgcgtgcaattttccgctcatacgtcattggtttagattactaccaaaaagaatttgaagccgcgctggccgatgcgagtgcccgaggttactttaaaccttatggtggctataatgattctggtctgaaagcagattatctctatgccaagaagtaccgtgtcgacgctaacgctaacatcggtgaaattcagttagttgaagaagttgatggtgctgagcgatccgtacgggttgaactaaaagttgcggagcatggctataccatcggctatctgccgaaaaagcaggtcgacgaagccttcaacgtgatcgacatttacgctaactcggtcatgaccctctcctccaaaactaatttaactggtggtgaatggaagatggcgatcgatgctgtcgatgaaatgcagtacctgaatgatcccaacgctcaaaatcgggcccttcccgattacggtgccattgacacccccttaaaaatcaagaccggtaaaaagtcctacttcctccaattcaccctatatgaaatggaaatcagcaatgatgagattccattgtatagtttagtcgacacagtcgacggtcaacgtggctcaattgttgaagttgatgctggtccgatctcatatgtgatcgacgtccaagctgggccacagactgggtccaagattacggtcattcctgaacaaatcgaccgcgtcatttgggtccctaactggaaataggtcaatcaccgttatcaagtgaggttattttaatgaaaaaattaatcttagtgatcctgttacttctgtcaatcggtgtgatgaccatcgttgattcgaacatcatccgacaagccccttatccgagcttgtcccaagaacaaacgaaataaggaggtccgaacgtgacccgggcaattttaatcagtttctgcgccctattccttttagcaggctgcacttcccaagctgagccaagtatttccactaagcaagcgaactcagttgcagccgctaaccgcgcggagcaaactagtcgtgccaatgcagcggctgatgctagtgctaagaagcaatctggtgaccattatcaagctactgacgaccatatcactagcgcaactagtgcagtggccgccgtcgggcaagtgctcaacgatcccaagcaacaaacctttggtgtcgtaccaactgccaaccaagatgcacacggccaccactattatcaggtcgatgcttatcagaaaacggctaatggcggccgggggcattatctgaatagttactttgtttatttagatggtagtatcacgaccaaacaagcaaattaataaacagacaagttgtcacccattcaagcagtgtcgttgaacctgctgggatgggtgactttttggatgcattttttgccggtagtaatttcagtatttcggcgtacagttattccatgctaattaaggcaagccccagtaactaagcaaccaatttgcaattacaattaatatcaactgcataaatatagaaaaaggtttatttttttgttacttttcgctataatggatattgttgttaaagcaactgccccagtggcggaactggcagacgcgcagcgttcaggtcgctgtattggaaacaatgtacaggttcgaatcctgcctggggcataatttggtaaactagatgaagcttggattctgttaaacgttgatttaacggcattcaagtttttttcatttgtactaaaaaacactactaatttcaaaaatttgtctttatttgtctttatttgtctttaagacataaatgtatacttttgaatattagttattaaaaaaatcccccacgccgaagcgcaggggaattaatcaagttataactatcatctagaaactacactagagacagatattattatacttattgcttactactctgtaaaccctagtagttgtctcattagctatattgacaactaattatgctaaaactaaaatcgcactaaccaaatacacaggtaagtaatataaaaaaatcttccgcccatcaaagcagaagattatcctcatcacctctggcatcattagctgacaatcttggaggaattcgaaagccatgatactaataacaggacaaaggacataataacgcttgtcagtttatattacaataccgaaagtagtctatacaaacatattaataactccttgtgatatttatccactttgaggtataatcattattgttcccttcttaattcctagggagcagaacacccattttatttatttaagccttgaaccagccttggctggttctttttgtatgtttctgttaataaaaggatcccccacaccgaagcatgggggactagaacagttcacgattattatactacttttagcttgcttgtgaggcggattctgacgtcgtttcggcatttggttgcgcattggtatccaaattagccgctagcgatgacgctaaagtggctgctgaactagccgtggccgtgtcaccaactgccgccgcactagctgcttgactgtaagccgccactactgcctgtgatgcttgggcttcggcttgactagccgccgctgagttagctgcttcaatcttagcttgagcttccgccaaagcttccacgaccgtttgttccgtataagctaacgtgctcgacttggtcttgatcgtgttgccggtatcttccaaaatagaattatccgtaattaccccgacaaaggctaggattgcccccacggcggtaatcactaatacaactgcattagcgtcaatcttgacaccaaagaagaccgttgcgacagctaagccaataatcaacacggacccgataatctgggcccaataagcaggcttcttgtagttagctttgagtgttgcctgaattacatttaaaaattttgtcattgtttttccctcctaaaggaacttttctgcgatgtaaataactaacgtgacgagcacgccactaaccaagacaccgatcaaccaattttgaatggttgtcacacggtcaatttgatggctagcttcgatggacttggccagtgccttgtccgctttgtcgccaatatcgtcaacttgattcaatttttcttcgatgttctcaacttttgttttagtggcggccacatccttttgaatatccattaataacttggttgtatcgtcgtattgtgccattaccgcaccaccaatcgctggccaggatagatagtagtataaattgactttccattctggctagctagtgtagtcatgctcaggccgttgcgttgtgcaattgtccaccagctgtcaccggacttgactgtgtaatacgtatgactaaccagctgaccagtaactcgcttcccgtagtcatgaccattagtgacgcctaacttgatgaaggcgtataggccatttgaacgagtgtagcgtgcccatacatagtcgtgttcaataatgaccgcattgtaagtcacactttcacccttgtaataggtggctacttggcttaccttatctgaatccgtgtaacgaacagctagtgtccgattaggatagaacacccctcgctggttgtatttaacgaccttaaagttggccttcttagctgcctgagcctgcttaacgttggtttgagcttgtttcttactagcagtcgtatagcctaatttagtgatccctgttaaatcgacattgccgtctaatccgcctgctttatacattgaagtaaactgaaagatagccacaccgtccattgatgggaagtagttataatcagggctagttctaaccagataatccggatattcaggtacccataaacaactaccgtatgccttcaaaatcaagctcacattaacatgataattgaggtaagctttaccggaatacagcatcggcgtatagccagcgtctttaatcagcttcatctgagctagaatgacattagtattggctgtcacgctattagaagcaccgtcctcatagtccaacgccacaatgctgcccttgggcgtcctaacacgtggcaagtaataggccatcatagccttggcattggtcatattgccaccaacaccgtcccataaataggtgtgcacccgtttaccagcctgttgagctgatttgacttggctgttatacgtggtctgagggatattagtcccaccatagaaaccaccggcctgtgagaatacaaacttatcggaactatagccgaatgtcccactattaccgttatacttagaccaatccggcccttgatcacgactagttgacgcctgactggtaacattgaccattaaaaaggccataaaaatggcgcccaccgttaagatgagtgcctttaacttgtgcttattcaattgtctacctcctattcactttatcaaaatatcagcgcacacttgcaactgtgtcgtagttgtaatagctgttgcggtaccagcaatgttatgtttcaatactgaaacagcaccgttagggttccatgataaacagtataaattccaaccagatgattgttgaacaacagcaacattctctgcaataatgccgattgaagatggcaagttaaacaacgtcgtagccgaaccaatagctaaatttgcacttggagaaactacaccactaacgtgtagtttgttaccagttcgcacatagttcaaagcacccgtgctactagttgtgcctgccttgtaaaatgccggcgtcacatccaggttgccagaagtatattttattttattatcaataagtgtgtttacttggtcgttagtcataacaccttgtggcccagtatcacctttatctcccttatctcccttagcaatcgtgcttgcggctttattcattgctgccacaaagtcatcaaaagtaatggtcgtaatcgtggtaccattggtgctttgaatgttattggtaattgtaaaaccagtcgtcccatcactagggtagattgacgttccggtactatcaaccacccatacttcaatggcatagctaccagcggttaaactagtcatcaagtcagcattaaagttaacggtaacttgaccagtcgtggggtcggttaaactagctgggtcaactttggccgatttaagatagccactagtattgcctaatttaacggtaattgacgtggcattagttaagttcgttgccacattatcattgccacaaattaacgtaaagctagtggtggtatcaccaattttaaccgtttgtggtgaagtatcggtaaaactaagcgtcttcgccatctttaggtgcctccttctcggccaacttggcattgagctggtcaatttgaacttgtgccatcgctaattgctgatctttaacggcaattgcttgggcatagttactcgtcatcttgttaattaaggcctgtgcatcgatattcataatttaagcctcctgtgtggtagtggttgtcgtagtcgtggtaactggctttaaagcagtcaggctatcaatcagagtatttaatacttttaacttaacgctatcaatgccaccagcacctccagcaatggcagtgttaaattcatccatggtaatactgacctgtgaactgatacccagcgtgttaatctgaacgctaatggtcataatgttgttcgtgtaatctggtttgtaatttgtaatcaaaatgctatccatttaatttggcctccaatttgtttagtctagcttccaattccatgttgtgaccgtttagttggtcaatttgcttctgttgttcctgtaccgtggctagggtggcatttaaaagcacactatcatccaccccacttagcttgccgttttcatcacgactaataaatacgtctggcaattgccactgttttgttacattaacgtcgtcaacaatgctagacagccgcaaatgactggtattatcgtctgttttgtactgataagtggctaaatcaattgagttaactagctgcgcccaataagctgtgtcagcctttttaacgtccttcttgacgcttaatagggacgatttaactaagctagtatagttaaccgtagcagcgaatatatcaacagagctaccattggcacggttaaaatgaatcgggcggttgtcggaactggtaatcgtgtgataggtatttatgttgaagttgccaatatctaaagaacgattaaattgaatgttattagcacccgagccatcaataccaaagctggctgtcttcatagttggaccattaccgacataccagatattctgtgtgccattagggttgatattgccgtagggcgtaataattatacccttcggtgtaacatcagcagaagtaccgttaaaggtgatttgttgagtatctccgtgtagcgtcagcccatccaacggactgatcagaacttgaccagttaattggcttccagaaacggattgtgaaaatgacatatccttgccattagtaaagccagagttcaaagaaatcatatcgccactaaaattgccatcataagcttcatattgacttccggaagagtttatggcgcgatacatggttcttagtccgccaccactcatctctgtccttagagcgcccattgagttaaaaagtgtcgtggaagctttgccagtaggttcaatggtgaatggataaaaattactcgtattattagaatcactaatactgtcgccaccatggaacgttgtcccattaatggttgaaccattgataactgagccatctatttcgccagcgctaacaacattacctgtatctggctggtaaccagtagcttgagcagtttgggttagcataggtgaactaaatgctgcatgtcccttaccgttgtaagcataaagctgaatggcaacatacttagcattgcttgggacaattgcattgttaattgtaaatgtttgtataccactgtctaaaccattagctgtgtacacctgttgcaagtagccaaccctagtgttggcatcataagcactaaaaaagcctagtgtgaatgtatatagcattccgcttgccgatccatagtccctaaacttaatcgaggcactatatggtattcctgtttgggtgactggttgaaacttactattagcatagttatcccatctgcctgttgcatcaccattccaaactattgctggaacaccttcaaatgattcagtgcctgaataataaggttctccattaagtccccatcccggaatgctggagccactaccacctaataatgcagcattataaactaggttagtaacacctctaattgttaaattgctagccaccacattaccgtttgcatcggttgtaaatgagccattaggcgtgctaaacgtgttagccacaatgtcgacacctttgagtgagccggttgtaacatcacctaaattggcacttaaagctgatagtttgtcgacatttaaccggtcagtgctgagtgttcctgttgtgatgtttgatgcgttgatatttttaccagtaattgtattaaagtcaatcgtgccagctgttaatttattggcactaacattactaacttgggcatcagtgatagctgcattggctatctgagcagtgccaacagccaaggaccctatcttggcattagtaattgcgccatcacctatttgggcggtacctacagctaagtcagcaatctgtgccgtacctacagcctcattacctatctgggcattggtaattgcaccattggctatctcagccgtaccgatgacccctttatcaataactgtctctgttgtgatatggactaccgagccgtccttaacacctgcactcaacgtctgataatcagcacttgctttgttggcactcactgttgcttgactaccagctagtacggcacttgaggcagcttgactagcactattagcaatactggttgcattgttaccagcactttgagcttgactggctaccacaacggcttgtgatgcaacctgactagcactattgccagttaccgttgcctgtgaagcgactatagcagcactagaagcagattgactagccactgcaacactagactgcatgttatcaatgtcagtgttataggcgtcctttaaggcggtctgtacattgcttagagccatattgtaagcgtctgtgaggctcttataagtgttccgattgacatcactggccttagtggtatccgttaagatggccgtcataaaggtgttcaggttagtataggctgtggttaaagcggtcgtactgatactggcatctttagcacgggctagaatcacattatactgacttgttaatccggcatattgtgctgcttgggtctgcttttcaatgacactcattaaattggggtcatttaaatcggtgaccccactagcggcagtatcagctgtactttgagccttgataattttaaggccatcatcggttaagatgacctgtgttgcattagattctgccatttataaacctcctttcttaatcattgctaattgtagccattggcaaacgttccttaattggtattacaaagacacgttctaaagaagcaccttgatattgacaattgaaagtcgccaataactccggctggttagtctgactatagataatgttgcatgtttcaggttcgataacatcatcggttaaccctaaattcatatccagtaaatagttagaggcgaattcttgcccgccatgaacaacattaatggcgtacaccatacgggggtctttcatgttgtaatcacccgagttaaagtacacatatggaaagtcaatgccttgtgattggtaggtttgttggttctcgtcaaacccatagttgtcaacatcaaaactatatagcacatcataattaccttgtttaacctcatcgagtcgtagcacatcatgtttaccattcacgtagccacacagtacgtacccatgtttgaaatcaacgctgactcttatataacgatcgacagtgcaaaaacgtgtgattctatcatcatcattgcctagggtaacattagcaaggtagggtatgcgactaactgcatattcgttaacgtttaaattaggcttggttgcggaccaaatgtaaatagcaccacttacctcttcgattgaaaagctagagccatgcccgccatgcgaaacaatcatcttgctaattggcttaaaattagtgtcatgtaagacaaacatggtatcgccggttgtactttgattaatcgcccggctagttatatactgaccgttgctcaaaggacacatatattgtgccgcctcagttattcctagtgtactgtcgtctgggctaaaactacccaaactacgaatagcactagtttttaacttaatctctggttcatcttgaatgtaacgagtctcaatagtcccgtgcagtgtgccaacggaattgtatgctgcttgtactaaatagccagtttgattgaaactagtatcaagggtgccgtcagtattatagcggtgccaaataaatcccttgttatcaatataggctgaaatattggtgttaccttcccaagcctgtaaaattaaccgtttggtttgcgcagtatcagtgaagttgttgccgtcaggagttaaagcaaccggtttaaccgagctagcgtcctcccttgccttttcaatggcgctattaatagcactttgatagccttgcatccaggctggtgttgcaacaggtaccgtgacatattcaccaaagccaactgtattgccataagggttagaaaaactaattgtccgttgaatgactcggccactggcatctaatgctggcttgattaactcatctttaaacctaatcgtggcacctaatggcgggttaaatttagacgttacactaacctcataatacgttcgcgggtgattatataattgcaacatttcttcggcccaagccttaattccggaagggtcttcaattgagttagccgtaatgactgcttcatagtacaaaccagattgccagtcagggttatatttctggttagcctcatcatcaacaatgtaaggtttgccatcattaactgctgacattgtattgccgttgtcaccataagcaatcagcttggtaacaggtgttgacaccgttgttcgctttaagctagtcatattcttaccaaatactgcctcgttatagaccacatcagcattaagctggtcagtaatgacacacacctttttcgtgatgttaccttgtgagtcaatctcaacataaggatcgatctcaacgttataggtctggattagtgtctgcactaaggtactagcttttgttttaccatcaatggtaatcgatggagtcatcacattagtagtctgatagtctagcgtccagccagtagcgttaaagcactggttaaaagccgtctgaatcgaactagcactagccgtaattgccactgggtaatgatgagctagtgtgtataagcatagattggtaaagttaatggtcgttgtatgtttaacagcggcactagaagcgtcatcagttgaatagatatacatgacataccaatggcctgatagctcgtcataataagctaggttgttgccagcgactactttatctgaatcaggctggccttgaagcacgtctaatgaaccttgatgatcgaacttcttagactgggcatttagattaatcgtgccgttaaagttgtcatcagagcccacattaacgtcatcatcatatgacgtactagttgtgtctgaatcagctagttgtatcttcacgctatcgtttgaaaacttagtagccccatcaacggtcaatgtaccaatccgctttaaattagggtctagaattaaatactggttatttaaagccatctattttaacctccttgtttagttatgtatgtaaaaaggccgcccttaattgggaagcctttagtattgttatagtattcttggtagatatttcagggtcatttgagcgtcatctaggtcaccaatcattgacaaaccattaacgcccggtttcaacttaggaaagtcggttgaccaaactggtgaaactagcttgccgtttacagtaaccgtatcagtctcacagtccatcacaatttcttcaccggcgccagcaatataagttggctttgttgtgtcaactttattgacttgccatatttgaaggtcagtcattgacataaaggggttacgataggcaattttataattatcttctgtaattgggtgctttaggaagacagaaccaatcccacccaaggctgtctgatacttattttgagtatcaacataggttccatgcactaacatgtgaatattagggtccaggaatggttggcctgttttggtcgaatactgggtgatactccaggtaaatacttgtcctcgtttagtgatgtccaacattagccaagcacctgccagcgcggagtcctcctctttattgaccacggttgtataggtatcaacggtttcgttaacggttttcttagttacttttccacttttggaacgcccatatttagtgacagttttggttgtcgtgccagttttgatttgaattttctggtcaggcttatttgtaaaagaacctgctggtcctgaaccgtaatacaagtcagtatatctgtcaccatattctaatgttgatcctggctcgcatatttgaagtctagccatgggtttagcaccataggccatgtcacgcatgccaaagcgtccaatagtgttaccgttagggtctaatagtaagacttcaacacgtcccatcgcacggctgttatgagtaccgttgtacctgaattgatgaataccggttcgtactcgccagtcagtcagcgattgtgtcatgccagtataacgataagctggaccataccagcggtcttcaccagttgttggaattgtaccaaagtcatatccagcgctagttacagctggccgcattacattggttgaagtcttaatttcactgtggccttgatacgtatacgtttcaccagtcttcatattactaagtgcattggcgtcgtttgtccacattgccatagttcctagcggatcatcaacaaccttagtataaggctgagttgcagttgcttgatctccaggtgactctgggcctaaacccaactggcctccatttaaactgaatccaatatactttaaatcacgtttaggtatgacctggataaccggttctgttcgtgcagtgccatcaacagtaatcgtgtttaagccattatttaaaggcttctcaacctgtggtaatgttgcccgtgggtcagactgcacaaaggtaatcgttagtgtagcgtcccacgttccctggttaatgaactgtgggtcactaatcgcagtaatatgcccccagtaagtcactttgggttcaaagccaaagactagtgggtactctttaccattatcacttggatcatcacttagcaataagccactcaaattatgcataatctgattgtatttgtcctgactgccacgagcgataatagttattggaatactgattgtccgactagtatagtccataccattaaattgattaccatacatggcggggatatcggttgcttgctcggccatggctggtgcacttggcagtgttactgctcccataatggcttgcaaatcatcgcggctatttaagccagcatattcaaaatcatttttattcaaaacagacaattatatcgccatccttgtttaattttaactatgtaaaaaagagccttctaaggctcttcaatatattaatactaataccccatcatttgactatattgtgacgtcttcttggtatttgacttgacagcattaaccacgtcagagttggcaacaactgctttaacatctccttggccagtgaccaaagcatctagtgaagctataacccgctgtttgaatgcttcgtcggaatcaatctggtcgttaccggtatttatcacattagcgccatcttgagctccgaacttagccattatctgttgcataatttggtaagcccttgaacgcttagataagtccatcggaactatggcttctggcaagttgccttcaaacaatttgtaaacgcccgctttgtttccgaaaccaccatttgcatatccttcagggccgcttaccctagcgaatgcactgtcgcctttaccatatatatgtttcatatagttaatcccagctaataagtcatcatacccattataaatctgaccatgtcctgaaaatttatatgcttcaaatgttggccgaatagtttgaactaagcccattgatggaataccctttttagcgttagaatcccacaagttaatagctcttggattaccatttgattcacgtgcaataacacgcatccaagcagatacttggctagcggtagcaccaaaaccattagctttaagtgcccgaacaacatatggcttccatcgtgaaaccgagctacctgcagggtttcctacactgccaccagctccaccgaagttgtcagctaaatcagaaatagctttcgcaaatccttttaaagctcggtcaactagtcctttgcctaaatcatgaccgattgaaccgactcctggagttttggttggatcaaatgtctttaaagccattgactttaaagttttcaatgggtgagttatcttagacaatgcgtccattgctttatcactaatgctgtcgaaaatagaagtagcaccgttcttaattttctttaaaaacgacgcgatatcaatagtgcctttagcatagccaggaagcgtatgtcctaggccaccgttaaaaagcttagcagtatcaccagcattaagaatctgatcaccaggtttaacattaaccacttcagcaccattcataccaagaaatgacactttcccattgtctctatcaattttagcctcgacaccgccttcaccaactaaagctctagcagtgccaacaataccgccggaagcataagctccaatcgttactggattatatcccgattgataagcgccaacattgattggtttaataccaaatcctttaactagattactaaagaaactagtaatgtttttccaaatactatgaataccggagccttgcttatcggcagctttcatggagccattggcttgcttaacagcatgccccaaaacaccttttgactgtgattttgcctgatcaactaccgaactgttttgatccttagcatgtttaacaacttgtgatctttgcttatctgcgtcatcagtagtgtgcttgtactgacgatccgcatgttgttcagttttgttttcctgctctaaagcgttgtcaattgacttttgtttttggtccttagctttactaataatagctgcacgttgcttctcggcatacttagaattaccagaatattgatttttagcagcatcaactgttttactatactggctctttgcttggccgattgcctcgctagcttgtctttcagctgcttttataaccttattgtgttgcttttcagccgcagaaacacgatctttgtattcttggtttgccagtgagactgtctttttgtactctttattcgactgtgaaatagcatcatttgcttgttcacgagtgattttccccttgctcttggcaagatttctcaaaatatcattctgcttattagcagctgactttatctttcccgttaaagttgtgtgtaaacgggcttcttgtgcagtagtttctgttgcacttttaatccggagtttatcaagagcggctgactttttgttttcttcagcctgaatagctgctttctttttagacatgtctttctgaacaataatcgagttggcaccaaaccgtcgttcgtcagatgctattttagcatcccagctagaactagtttgtctctctctagcattccatttactaataatacttgctttttgctgcgcataatacttcgcaatagcgttgcgatcagaagctgacattttttcaaaacgatttgtctcactatcattctttttaattgaagctaattgctttttatactccgcatcggttagcatacctgctttatgaagtacgttcacatcatttaaatcttgcttctgctttttagaataataggaactatacgccttacttagatcactcagtgagtgcttagtggactctgtcttaatcttgggagcttcaatgctcttcccttttagcgcatcactaattcttttaacaatcgtatttgcagttttagtaccaccaacaccatcaccaatgcttgctcctaacattgctcccgcagctgttcctgctcccgggataacacttccaagggctgcaccaatgccacccccgataagtgttccagctgttttaccagttgctttatatttatcagacgccttaccggagctaactgctttcgcaatgctactaccagcgtcccaagcagtcatggctaatccagcaccattgataatccttgtaccaattgttcttcctagcaatgaccatttactgcttttagcaattttttcagtgttttctgcttcaactgatatagagcttaaatcagcgcctatattcccagcctttctacctttaactctccgataaccagttccaacattttcttcactggccatacttagttcagcattagttttaagaaccgcgttttgctcttctaaagctttagtttcttgtttaatacctagaactttttcagcccagctaacagtatcactgatttttttaaaagttgacagaactgaactagtctctttgacggctttacttgttaaccaccatgctgcgccaaattttgcaattgtttctgtgtgcccaccaaccatactgagtaatggctttaaaagtgcattggttattttaagcgattcaattaacgtttcaaagcccagaccacccaagtttttgacagttttgaagaaatcaacaatttccggagcatttctggcaatagagtcagaagctttggtgacacccttggccaagttatccattgcatcattcattgcttttggtgctgacttgacatcaaaggctttagcaaaagctttagtaatcgtgctaatacccttttctgccgccacaccgaccttatcaaactccttgtcagtccgtttgtcagatacccattttgaaactgcaccatagattggattttgagcggtcaaaattggcttttcaatgtcaccaattaaagctggaacacgcgctttgattgtacgttccataccaaccatcgtatgtaacatgttgtcggcggctttatcgtattttccggatccaagttgattaaacgtattttcaatatctttagcagatattttgcccgctttagccatggccgctaaatcagcaaccgttacttccttaccatgattgacttgagtttcatacttagctaactgttcacggaacatcgggaaatactggctaatttggtttaacatgccagcatttgcttttccccgtgacagaccgttgaccatatcttgggtaaccgcctgaatttgttggctatctaaaccaacagcgtcagccatgttcagcatggatttggttagttcatctgattcttttttattggaatgtaagtgataaaaaccttgctctaattcatttacaacatctacggcttgaccggtcttaacagataagtcgttgattgttttaaccattgcgttagatttgccaacagtgccagttaaagtcaaccaagtggccaccatcttctgctgctctttttcatattccataccagcgctaatagcttcgtgaatatgtgaagtaattgattgaaaagcgctcgtaataccattggcaactaaatgagcacccagaattttgccaaataaatgattggccttatctgcgtgctcgtttactctatttagctggctaatgactgacgttaatcctgactgtggctttttgcttaattgctcatcaagctctttcatcttagtccgagtttgggcaattttagtgcctaattcgttcactcgaatagattgttgcttatatgcatttgagctttcgccactgaccgatttaattctattgagctcttcgctttctgcttttaattgtttattaaggttatcataggcctctcgcaagccattagatttagccttatttgcttccaactcatttccttcggccttaaatctcgacactaaagcagccatagacccttcaattagtttgctctgcccacgcaagttttccatattttttaagtgggtttgctctggtgaatttagactattcagttctgacttggattttgctaactcagcagtgagttcactaactctgatcttttgttgttgatatgattcagcagttaccttggagtcttctgacatttttatcagctgatgcgattcagattcataaagagccttgagactttttattttatctttaaggctatctttttgacttgcgagcgcttcgtcttctttaccttcagcctttaatttggcaatataattagcacttattttattttgtgcttccatggcgtcctttaattgtaagacaccacttttttgcagatcaagtgacttctgtgctcgttcttgttgcccctctaaactggcgattgagcgcttggtagcgttaatctgattttcatatttaacataagcttctcggcctttttgagtggtttggtctaatccgttttgctcgcttttgagacgctcaattactaatcgttgtgcttcaatagctcggccagcatctttgactttacccgcataagccgccataataccttcacccgaacggatttcagcaaagttagcttgcataccagattttagtaattttgcttcattctttatttctcgcaacgtgcgagtcatgccaccatcgtccatgttaattgcgaattcgtagccttgaattttctctgttgccatactttgcctcctttacaacgcaccgatttgacgtgctaattcgagcggatcttgaacacggtctttacgtgacttggcattcaatgctgtttgcatttcactaaatgagctttgataaaagtcactaggcaatatgccttgtgaaatcaattgattagcgatgtaatcaatatcctgaataaaattatcaagttgccaaatcattctggctttggcaattttgggtcttcttcctcttcctgatcgctgctgttgcctacagatggtaattctactcccaagaattgttttaaacagtcattaaagaagtcgtattcgtcgctaaccgaaaattccatggacatgacacgtttcttttgcgaagcatttagttccaataaatcacaggtcgtttcagccacaacctttgcaagcttaggtgttaattcgactacacctgtaatactatcctcagtttcttcagtagtcttgatgaacttcttatatgcttcggccattttttcaacattttgaccactatcaatcaacgtatactgcgtgcccgtcccaattttcttgccatcaaatttaactgattttgccattatttatatgcccctttgtgtattgtttattatcatttattgtgaacccgtgcttagaatgcgcttctcagcatgtttaaaagccgcccctagcggtattgtggatttattttaggcgaccataattatcatttattactggttggcgcagatgagtcactatcagttttactagtctgtgagcctgtgtcagttgtagctttattgaccactggtgccgttactcgcgtttttataaaacgtttgtccaggaaatacagcgtcaaacatcgcttgcttatcaaatttaggatctgactcagcatataccttgtacggttggccaccgaagccatcatagttcaaggcggtaaatgtcaaattatcatcgtcgcgagtttcagccgtatcagtgtttgtttgaatgttctgaccagcttcattaaagattccacgaccaaagcaataataaatcgcggttcgaaagataggagaacgagattcaataatcagaccagcttcaaccggcttgtcagtatcagagtaaccgcccttgccatctgatacccgtcccaatagcttttgtttaacaataaagttgatttcgttcgaatcaatcgcgactgatggtgccgaaggtggattagaaacatccacaacttcattgttgccagtaattttagataccgttccagatagcccggtaatgttagcagtcttagtacccaagttaccgtttgctttgctagtatcaatggggtataccccagcggccgacaaccccttatctgcatcaataaccgttgacccgtcatcggctttaataccggtgtataacatgtttaaacctaatgttgccatttaaatggcctcctttatataattaaatttcaaagtgtttgtgatactttctgaatctggtgttaatgtctggccagcatcgctataacaacgaatatcattggtcaacagcacttgttttaacccggattcgatggcatccatatcgcccaagtaatctttaggataatagagctgtatctggacttgcttcgttgattggaatggaatcccattgccataatcttgactacgttcaggtaacccgcttattactacaataggctcgtcagttgaagtatcgttaattggaataaaaaagctatggatatgttccacagctagttctggtatttcattaatatttgaaacaattatgcttttaataaaagctaccggcgtcacttgcccaccttcttgtccatagcagtctttaattgttcaacaactgccttgccaacttggccttttgcttcacgctgagtagtctcccaaaagtgtttcccggaaacatggctgtgtttggaaccattacggtcaacaacgtcccagccatcattttgaaaacgtgcaatgtaccctttttcacctttggctgtaaagccaacgttaaccgagccattaggatgatctacagcaattaatgaatcacgtagatgtactttttcagcatgaccatgtaccttgcgtagttttcctacaggaatcttaggcttcataattttgatgaactgatccgctccagctgcattagctttaagcttctcttcacgtccaaagccttccgccatagtatctaaaatatgttcaaatgagtctgcatgtttaatctcattcgccacgcccgatcaccaccttatgacaagttatgaggtcaaagccatccggtggtaaaccatcatcgtaggccacatcatcaatctggtaaacatcctgatgattgcgtcgtaattgcatgccggtagttatttttagattatgacgcacaaagtaaacggcattctgttgcgaggtgtcaccatttaacgctaacctttgctgaaacgacaatgaccattcgccggcgtacaaactgaattgagggacaaaatcagtaataggattacccgtattagggttaacttttccagtagctgcctgagttccaaactccaatctaaaattcattcgtgtaggattaattgctttcgtcatttgtccccgcctcatattgcttttgactgtacaaccctctgagttgaccaatgattgagtccacgaccagatcaactggattaacagcgatggctgtaatcgatgttcgataagtccaatatgaaccagctaaggcgtaaacagccgtttcaaacaaatcattcacgccttccatttcatagaaccccgtaacaccattttcatcaccaatggcctgtttaatgtagctagtggctgcagacaagtagcctgttagcagctcgtcgtcatcattcccgtcaattcgcaaagacgatttcaatgtttttaaatcggctgccacttaaatcacatccttacttagccgcccaggttataactgtattgtttatttatcggcgacacagttgctaattgcttattaagctgttgttggagcagaacttgctgcaaagttggctggttggtcagcaattttactgaatgagcctgcaacaaaggcatccgtatcagtagcttcaacgtcaaaacggtcaatgacacgaatcttagtttgatccttttcaaaggcaccaccaccaatgttggtagtcagtaatgaaagattttctcggtcaaacaaagttaccgcttgtgataagtcaccatagtaaagtgggtaagctggagctgacgcagtgccaacgttaggcaaccacttgtcggcaacttccacaatccgtttgccgcgaattaaatattggtcaggttgtgttggatctggttgtaataagtagcgacccatagcatccttaacctcggaaagtacattcaaaccagaagtatttgtcattaagaatgacgtagccttgatggcaggatcaacggaagtgttaatcatggtgataatgtcatcgaacttagccaagctaggtttcttaggcgctgcgttcattgctgcaataatcttagcgttgcgagtaacaacaaccttcttagcaatccatccagataaccaagataagatgttgtcggccgtgtcctttaacagtgaattagtagcggtggtaataccagcataccgatgaatcgtgtatttgataagtgatagcttagggtcatcattgtcgccaatcgtagctgtttcatcatctaagtcagctaatggggtaacgtcagtccacttttcgtaaactcgtgaaccagtttgagttgaaacggcttctcgattaacgtattgctgtaatgaatcgtatttacgaaccagcgtattgattgccgtttgaatatcttggggaatcgtcaatccaattgcattgccagcttcgtcggtagaagacgttaccaagttcataactttaggatcgcctttaatcatgcctttgaagttcttgatgaattctgccttgatgtctttttccttagcatcaagtggcactttttccttatcactcatgttggcaatttcttgtgccttgcgttcctcttccaattgttcatgtaaagcgtcacggcgagcaaccgcgttgtcgcgatcttgcttcattgctttaaattgttcttggtcaaagctgtcgtcaagtagagttgcatttaatttgtcatttaagtctgatactttttgcccttgggcaatccaagcatcattcatagtgttaatattagccattagttggcctccttttgattttttccaaataaaatagccaatttgctgtttcgtaattcagcagattgactattagtagtattttcttttttagacggcttagctttatccttatccgccttgtaaatgagattcatcaacttgttaactgcagatttaggcggaatatgtgaaatagcgttcaccggttgcaattgttgatcattagcaaacataatttcgtcagcgaagcctttatcaacagcatcactagcggttaaccatgtttcatttgccattagttgtagcaagtcagcttgatccatgccagttttagcttcataagcactggcaatagattgatcaatgccatttaaaatgctggcttcgtgttccaaatcgtcagcattaccagctggttgtgaccaagccttatggatcataatttgtgcagttggtgagatgttgatgtgatcgccagccatagcaactacacttgccgcactagctgctaagccttgaatattaattgttacattgccagcataattctttagcatagtataaatttcactagccgcaaaaacatcgccaccattggaagcaatatcaacttcaagtgcttcatcatcaccactgtcatcatttaaaatgtcagcaacaccagaaggtgatactgctggcattccgaagaattgatagaagccagctgtttgatcatcaacaatatcgcctttaatcatcactttctttgtcatcattatcacctccttttcccgattgaattacaacttgttgtgtcgttggattcttagcatcaggcatttcatccggaaaataaccagtctgctgtaataaccaagttgcttgattattggcaatcgtaccatctttagctagccctgatagggtagctgcaaatgagtctcccaatgggtctacagcagttcgtatattggccgttatcttagcattaagcttattatccagctcagctaaaatagcctgtaaatagcgattaagggcattggtgtacatgcctttaatttggtcgatattactttgttggtcgccttggccattcaaatagctatcaggaataccgaaaactttagcaatttgcttactagtccaatctgtttggcttaacagcttggtaacatcggctttcatttctaatggcttgtaatcttcaagttgatcaataacaaccggaccaccgttagaactgttcacctgcttcataaagttacgtgaacggctagctttcatcttctcacttaacagtccaccgtgctgaatagataggacaccaggagcgctaattgaacgtgctaacgcagccaacgttaaactgttagacgaactcttgacttgtagctcatttgacaatgctttcaatggactgttacccgtcatgccaccatcggtactagcccaacgaatatgaatcatatcagactgtggcacatattgaagcacgcccaaattaggttcgtcaaaagtaactgtataggttaagccactgccgtcatctaataagtaggtttgcacttggctaggtcgcaaatattcccagcgtaaatctaaaccgttaggattacgccagcgatatgcaaagcattcaccacccaatagcaattgcgaatacattgactgccaaaaagtgtggccgttagccgtcgtgctaggattgtttagaatcccttgcgctcgtggcatgttagccattaattgcaccgtagctaagtccccagatatttggttaaccgctgaataaatatctgaattttccaaagcgtctttggcactaacatactcattatcgccagttggtgataggaaattaacaatgttatcgtcgtctactggtacgctttgaatactaactgaattattttttaccgttggtggttcaaaaaagggcattattaatcacctcctttttgtccagctgttacgacttctgaaagccagccaactaagaataaggctaccgcaattgctagaacgccctgtgcctgtccaaataaaaatgctgcatataccccagcaatcatacttagaataaagcacagcacatcaaagtaatgccagatagttgcaaaaaattgtttaaaaatcattaacatcatctcctagcaatcccgactccgggttattaaaccattctagaacttgtttttcgttcatacgttcaacctgtttatcaggattgtttacatctgaaaagtcttcaaagtgatacatggcttggaataaggcgtcaattagcgcatcaactacatcaattttcagcgtggccttagccttatcgacttgaataccaattttgtcttcataaatttcagcatttagtaatgccttttccataattcgatcatcgaatcggtcaactgacccttcaacaaaaatcgtctgcaaaaacttagttggatccttcaattcactagtccgttgccgaatggcttgcaatggccagcctgaattcaaatccaattgtttgattgtaggtgttagcccccacgcgtcatagccaaagaaaacaacttccagtcgatgccgttcaacaaagttaagtaaccactgataaacctgctcgtcattaatcagtccttgcggatggctactaattgtacaaaatccctttttagctaagtcccgataattaataccgtcttgtttttctttagcttcaatcgaaccagctttctgccagggaataaagctatgctgataaataaaccatcgtggtttgtcattattatcgcgataagggaatacaaacgctagcgccgtgttatcactaaacattgagtagtcaaaaccaatataaacttgccgatcgtcaaaactaaatgatggcacgatggctttttcaacgtcaggcagttttaagaagctgtcgaccgattgttctagccacaagttaaggttcttattttggaaatcgttgagtgtacccgacaaagcgtcagaatcgcgcttatctgtcaagccgttcagcaacacttctcgttggctcggtaaatctagcaagggattacttttaacccacatatcaggcttataagtttcgtccagattatcctgcgaccaaataagtcccaaatatgtatcagcatcgcgcaaataatcttgttccatggcttgctgaatcatacgctcatcatcgtggaatggcacggttggatcaggatacgctgttgatatttgaatgaactgcttattacgcactttaacttggcctgatacaatcttggaaatcttttgccgtgtctttacttcaccaatttcatcaaatatagccgttgtgaaatgaaatgagtcgtactggccggcttcatggctaatcgcccgtagcttgttattagtcttactcattgtgacttggtcagcttgtgatgacagcgtccgtgtatctaatccactatctttaattagtgttttaaacggttcaatcgttgcaatcttggctaacatcgacttaatgtagcctagaatcttgctcgtttgtttgtaattaatagaagatactaagtaatcttggttagacagtcccaacgattcaattaaatagctataagcagtgataatcgccataagataagttttaccttggccacgcgcaacggaaacaatagcccgtgaaaaacgtttaccaccgtcatcattacgccaaccaatcagcatagccataatgaatttttgccatggcattagtttagttggttcaccagtatcaacgttaggacatatggaagcgaatttaagcacttgatccactcgttttaccgagtaagcaaacggaaattcagtgctgtcttgacgttgtaaatctctaatgtgtcgaaaagctgctaacttaatcaaatatccagtggttaccttctcgtccaggacatcaaaggcatattttgtgccttcatcagtgtattgttggcgaatcgctgagcagtctaatgattgataagatccaataacatcatgtgtttgtgttaaatcaatcttcattattagcctcctagaaattctttcattcgatcagcaacgctacgttcgtctttgtggtcatctaaattcagctttaacaaatcgctgcgcgattttggcgacaatcctagttcagcgcctagtttagttagattcttaacggctgaatcgtaaatttgtgtcatgggattacgcttgtagcccacgaagtctcgaccaatttttttaccggtctgatcttgtaacgttttatagattgcttggacttcaccgttttcctggatatgtttatacgcattgcgataaatctcatattgggaagcatattgctctacaagcccgctatcaatgcgcttgactggggtattatcttctaaaaaaggcactaatcgacgccaaacgaccttagcttgccggcctaagtaagctggcggtgtacgtgttaattgaccgtcattgatgtctttatccatttttttcattttatctgcctcctttcactatttagcgacccccccctacctaaaaattttcaaaaattgttcccgtcacactttttttgcaatgtgtgtgctcttcctgagacgtgttagggggcgggggttgttttgattctcatcgtgattaactacattcataaatttaaagccgctcaaatcgaacgacaagtgtcaataaattgattgagtttatctaaattttcattttttgttcattaacacaacgattgacgatacatcattgatcggcgttacactttgtaactcgttgccttgaccagtgccatagtatgattgctcccagtccgtcttagcacgatgacaactcccacagataacagctaagttagcaacgttagctttcagtgtttcgtcaaactcaattggaataatatgatccacagtcttagcaggtgtaatgaggccttgcactttacagtaagcacataagtaatggtcacgctctaggacttgttgtcttagatgtgaccattgtcttgtacgatagaagttatattgctgacgcttatcctcattgcgataacgtgtaaccgtattgtacttgtgcgtgtattgcttatcggtaccacgtgcccaacgttgccggctagccaagtactcagcttcatgctcatagtgttgttggcaatagtggtcagggaacgtgaccatcgcatggcagttaggatagcggcatcttcttgtccttggcatattgcttcctccgtttcttatccaaactaaaagcgccatgctgtttagcacgacgcttcatccatttatctaagtgggcatccatctccgcttcttgtggcgttacgtagccgtatttggtgttaatcatctttgccatgagttgcctcgttgtcttccatattcattgtaattcctcctcgtatgtatcaaaaaaactcccgccaataagcgagagttagtttggagattgtccgttttggagccgtggacgcgtttaatgtgcttggtagggatttgcaccctacataacaacaccatcctgtgtcgcctcttaaaacgtctacctattccgccacaagcacgtgttagccaaaaagacatatcgaaaagactaacttcttcatcattgagtgccaatctgcttgtcgtctccgaagattttaccacgagctatcagagcagtcccaatagctaactaatcacgttatgcggtcaactcccattgggtgctgtatcacataactatatcgccggtaggcctcgaacctacatcccattgtggcttgccaattagcccacagcgattaccagtctgtaatttggaggattacttcatgcacgtcaatcacatttggcatactaccaatttagcacgattgtaggggtttaaaatacgcaattaatacgcgatttcatataatcccaatcccttagcacattccataataaactcatttcttaatttaaacgccttagtatgactaacgttgattaagtgatttgtaattagtccatcaatcgtgtattgctgatgtttcttaaagtatagttcatttacgattacttcagtgtcagggccaacgccatctaagcaatcgtcaatcacttcccgctgatgtttcaaagcattaatgcgtcgatcgtcatcaatcgtgataatcgtgttgagtgtcgtttccggatacttgtattgtgccttgccacctccaacattatcatcacgtggtacagttggataacgtaattcttgttcacgtttctcgatatacttgtcaatcttgggatagtcacgtagaatatcttcaacttttctaatcgtcgttcgtttcactaccaattcccctttcactcaactccataatgtcagcaatgaagtcctggccaatttgtgcttgttgctcagctgtcagtgccacgttcatttccaggttggcaaccatggctttcatttgaattgctttggcgtattcggtgtcagtcatttgtgtccctccaccgtataaccatcaagccacgcacgggcaatatcatctttggtcaaatttacatcagggcatacttcgtcagtcaagtcatataacatatcagtaatcccatagttgttccgcttatataattgaatataagaatccaatttctcagaaatcaccggcaactctgcgtatgtcttcttgaatacgtcatctgcaatcagccaatgtttgccattgataccagtagcaatccagtcaccaacgtatactttccctgaccctgttagatataattcagggctgtggtgagttccaagcattgttcctgcgtcaattaattcatacttatcaaccatctcattgcttccatcaaactgttcagccttaatagtggccgtgttacgataaactttaatcgtcgtcgccatctccttgcgaataatcagtaccaaagtaaggcttatctaagtgctccatctcaaacaaggcaatcgtaattccatcttttgttttcgtgtcgccttctacttggcaactaatagcatcatttattaatcgcctacgtagctctttcatttcatcactcatttttaatcctcctgaagattcttgagtgtgccttcccatgcacctttcatgtcagtgtttctggataccgactcagttaaatccatttttaactgccgatttttaggtgtgttcttgaaacttgatacaacataccaagcctgaaatacatttagccaaaatactttttctgggcgacctccctcatgattattcacaatttcaacctacacttctccaatggtttctaaaaattgcatgtttaatctgatgttattctttacgctatgttctgtattatcactcctagaagctagctgagtacttgaaatatcatcttccataactaatcctccccgaacgcccgcttacgttcctcgttagttggtttcttgacgattatcatggttaatcctctggaattaaagcaacatagtcacctttaaactttgcatgggaataatcaatgccatgcttatcaagatactttttgatgtccgggattgtgtcataagcatccggcttctctgggtcatctgaccgggtaaacatcttggaaaaatcatcatcactgttttcaggtgcatgactaataaattctcgattagctttgtagtaaaacccatttgcatctttttccccacgagtacctgttgcatacgcaagaaacaatctgattccacatccagggcagctccaacggttatagccgaacttaacatgcgttactttatcgtaaccacactgtggacacataaattcagcctttaccatctcaccatctttaggcatccatgtcggtttcttgaagtcaaacttaggatcagtattagagtcttcattcgttgcgcctgagtcttccggaacgaatgtatgtttttcctcacgaccagtatttaattcatcattacgaccagtaaccaactgatgtgacttaaaaatttcctcaaaactcaattcacgagttgcttcaactgttacggtcaaatcattgttttcaatctttaatttcataattacttaccgtcctctttggttgattttttatttgcttcggcatgttccttcattcgccggtgcttccgtttaatcgttgaacgcttcttagtgtgtttaggcattctcgtcctccgtaatgtagtatttgttctcgtcaatcgcgcgaatacgtctatcaatccaactgttactccgttttagctcccgagacgtcctagctttcacttgcttgccttccatgactaatttaatggaattatactgggtgcgcgtaatctccgtgtaatcgcccgatacggccttaattccaggcatcttatgcaagttagctagtttgctctcaggcacgttatccatgctgccatatctcgcttccagcttatgaattacttctagttctttaggccaatttttgctcgccataggctaacttcctttcaagctcctgttcgtaatgatcgtgtatctcattcgtacaatttgggcatggtccaaacgtgaaaccataactcccaagtggtcgctgaacaactttcctaccatgacataattcacaactcatacacttctgactccttccatgttgtcaaacagcaattgacagttagtgtccttggtatataaacgatcgattgtctgaccgctatacatgttttctaactggcttcgtgtattgtttgtggtgataatcgttgctagtttgccatcgttaatgttaaggttccatctggcattggcaacgtcatacatcaacgtacgtaaatctttgtgcactggcttgtagaaccctttttcagtcggcttaccaccttcagtaccaaagtcgtctagcaccaacacgtcgacttttttcatgtcctttagaacatagtttaagcgttctctgacatctggcgcatcgtatttctcgttgaccagccgtagcagctcagctgttgaaacaaacatcgctgtttggcctacgctcattagctgatacataattgctagcgctaatgatgttttaccaacaccagggccacctgcaagtgctacgttgaactggttagtctctaattgcctagctaacttaaatgcctgattgccaagctctctagctttagcttgattaggctgtttatcaacctgccaatcattaaagctaaatcgtagtggcacacctccagaccaaactgacatgtgatagtaataccgttttcggttagcaattacgcccgcattcgcccgatcaatcgtttgatgatccaattcttctttggttggcaacttagttgtatcaattcctctagccgctactactttctgaatcgtggcttgattaaataacttcgttacattttccattagccaaaccagtcctctcgtgtttgtggtgctgtgttgttagaactgttgccacttgaagttagttcgtaatcgtcagtaaagcgtccgttaaaccaagtggacccattcatcggcgatttccaagggttagcagctaagtgctttttatacaggcgtaaccgttcaaacaagtacgcattattatgattaaccgacttattacgccaagctttgtagtgattaaacgcgcggcctttgtcttgcttgttggggtactctttccaaatttcctcaaaatcttttttcagttgcacaagcggtgtggcgttagccgcactatgttttttattacttgtattattaactgtagtattaatacttgtattattaactcccaaattattttgggtaggggtatgcaaattattttgggtagggtacacaagaatttttatatacctatgcaaaattttttgtgtaccctcttcgtagataacttcccttacaatgtggccattattttctaatgcctttagccaattctgaattgtttgtttagaaaccccgtataagtttgcaaagtaactatcacttgcccagcaataccctttttgattacataaggctgttatctcgccatacaataatgacgcttttcccggaagattgttgtcgtacctaacgcttgcgggaataatggcgtaatagtttggtctttcaactttttccgtcatatcagttcctccaatcatgggcattccacccacccggtgtattagtcactgctgtatttacctttcaagccaattcgttttaacgtttctttatctagttttatcccatctactgggacgtggtattttgcactaaatgccacggagccaatttgctcaatctcgctgtgatggactcgacacaatgccataacgtgccgtttggtgtggtcaacgtgtgttctgttcaagccggctccaataacgtctacatgatggatatcagcacgattaccgcagatcatgcaaactcggtggcggcaacattgaaacagataatactcttgctcacgtggcaatagctgatagccttccttgaacggcacgtgccactcaaacatgaagtcgataactaggtcgagtaactggttagcatcgctcacagacgattctgtggtgtctgacaggctaatctgcttgccaaacgtatatgactcatattgcaaataaaacaagtttttcaagaagtctgtcggcatacctgaccacgtatagatgtcactaagcaacgcgaagaacaagcgtcgttgttgtggcctagctttacgtgtgtcagctatttcccagtccacataaaattggctgtgggagccgctaacggtctctatatggtctaaattaggcatctcatctaaccgtgtaaccaaatagtattgaccatcctgctcaattaactgcgctcgtgactgttgcatctagtcaccccaatgtttggaagctttgtttaataaccagcttaaattagaagggcgatccgtctggaattgggggaaaaccgccgccatggtaactattagctgattgactactatatcctggggcttgcgtattaccagcattactacttactggagtgttgaatccattaccctgttggctattagttgtcgtgccaaaaccaccacttgtgcttttgtgattgccaaagctactatttcctgtattgctactgcctgctggccgcttaacaccattcggtttgctaccatcctgcataaacggctcgtagcttttaactgctaaataggcttttccgtttgaaccagtatcccaatcaaccgtgattgccaattgatgccctactgcttgactgacaaactgttcaattgaatcaaatgctgtaccattacttgcgcctaaagctactgcaatggtgttaaagcgtttagcggataacttagctttgtcctccgaagtactgtcccagacctcattgtcaaaccggattaggccacctttgtatgggccgtctaaaacctcatagtcaaagattgccatgggcttgccagcctctttggttttcgtgtattgtgaactagacgcgataaccacattatatttacctgcttcttcgacagtttgtccgaaagtgttatttgaatctactgtaaatagtgccattttattttgctcctttagttatttgaattagttcatttgctttaatcaatttgcgattatcaattcggttcttggcgtgattccccttttcgggatctaaatcaatcatgcgttcgccacccgtcaaatagatccggccaacgaggtcaaacatactagtaaacgcattaaacgtcttttcgttcatgtcagcttggtatctaccctcaccactaatacctgatgaaccattgtcaagttgatgagcagtagcatatacggacttgccactttctttcaaaatcgtaccgagatctctaaaccacaattgtaatttttgataattctggcgattgtcctttgcggcattatcaatattttctaataccaagttttgaagtgctgtgatattgtctaatacaattacctgatacttagcatctgaaattccttgcatgacatattgttcaaccatggcctggatattcggcatatcacgatgttcaaagataataacatcgacgtccttatcaccaatcaaaacattgctcgacatatcgaaactgaacaacaacttgtggcctacaaactgtttcactacactggtcttaccggtaccaccatcaccatatatgaagtacatattgggtatcaccggaatgtttccgtccgcataaaacttcattttgcctcctacaaactaaacttaacggattcactggctggcttctcagttacaccatcaacaatctgtccatcttcaagcacgaattttccattaataatcgttccggacttctttaaatcagtttttttgatggtttccttggttttaataagttctttaattccttggtctcgtaatgactttagtacctttgtttcatcataattcagacctgccggtgtcttacgagtcgttacttttccatgtggagtatcgattttgaatttactgtcatgctgacgttcacgatatagataatccttcagcaatccgtggaaatattctcgactagattcattttcagtaagtttacgatcccgccaagcaattgtttgatcaatatctgcttgtgctgcttctttgacttcctgatcatgtttctcgattgcttgtagcttacgcatcgcccagtcagcagactgtagcgaattaatttgaaagccttcctgttcacgatcattaaccgtttctagctcttctttaagcaattcattaatcatcaaattaacccccgtaattcgttcaattctgtttcactcttatctaacatttcgtacaacttggccagtgattcaccatcactgatccaaatgctgttgataacacgctttagaaacttgatgtgattgttcacaatttcttccataactactgtcctcgctttcttagcacttgcaaacatttcgagttagcgttaacatatacgcacaccttgaattgttttcttgctccctactcttgtaatccactccagtagggagtatttttgtcttttagcttgcaaacgagactgctttggaataaagtagatgttggtattgagcatctcttccattagtccatcgttagccgttactagcgatggctttttttgtgcttgtttacactcgtggagtggtaaaactgatacttttggcatgatcattcctcctacttgagcacttgaataccattggtaataatttcgaattgttgtccattttgttcaattacagctacatctttttttgtacgcaacgtgaacggaattgacttgatttcaactactctgccaacgccggcttctcttatcagctgaccacaactatattcagctttgaaactcacccggtcacctacattaactttcatggtcattcctcccgatacattggtggcaatgtgaacgtccagctctcatcagaatttccatctggatcgcaatttccatctggatcgcaaacattaatatcgtgttcttgcaattcgccaataaattcttctgaatagccaaagcacgggcgccgcttaatgattccatctgtatcgtacgtgatagcgttaatcagctcacgttcatctgcacgaatcgcgttatacttacgtgctcttaacgcgtgctcaatgtcttctccatacatattgtttcctccttaaatttcccgttaaatggtttaaaacgtttttgaatttaggtatttttcaagttccttacgttcaatgcgttttagtctgccaatgctagttacctttaaaccgtcattaatcatcttatagactgtatttacactaccaatgtgaagctcttccatcacttgctggtaagtaagccattgaatctccgttttactcatatcatttcctccttaaattccaaaccagtttctaatctcccggcgcttataccatacggatgttagcgcccaagttaataccgctacttctaccatggcaattcctcccaatgagattccaaaaattcagctatcgcgttggccttaaacttccaggcactgccacgtcccctgtgaattatttggccttgttgctccatacgtccaatctcacgactgtacttaggattttcaagtatgttctttttcaaccaatcaattgacttgttaccgcaccagattcgtaaatctgccatagtccaagtacggccattcatagtctgatccagcaacttgttatacgcctctttatcaactaatacgtattggtccatgtttttaacgtgcatcggaactgctgccacttttaatgcttgcataatagagtctcctttctaatttcatattgctagtccttccatgctggcttagttgtatacttgatttatctcaattaatcgaggtgataagatatggatggtttggataaactggtgtccgattttgatcgcatgagcaacaatgccaaagaacttgatggcgatcataaagtttcctttgagaatttatttaccaatgatttcttgaacaaatatacaagcttcaagacaacaggtgatttgctaagcgctatcccggcagataacgttaaatcctttgatgattttgataaacctgtagttgacgaaatcattaacaaaaattcacagttttcaagttttactgaaatgcgagatgaagctattgaattttatgttctaaatggcttatctaatggaacttcatttgatattcagtaattttagacatcgtattttgcagttgtttgacctggtctgatgcctcgtcaagcagcttttttaattcatctaaactttcaattgttacatttaattgttccatctaactcacctcctatgctggctgttcaactaatggcatgattccctttgatttcaaaaagtcatataagaacttttgccccgcttgtgtccatttcatcgtgttacgtacctgcttgatgccatcgctattcgtatactcgtatggttcaacgtgcgtatagccttcgtcttgatacttcgcgtacaatagccacgttttgccttgcttgtattgaatgcctaagccatgaagcaacttgttaaactcacgtgtcgagtaaccgtagttcttagcaattattgagattgtttccagtcccttgttagctaacatgctatcggtgtaatctgccttaggcttcagcactgaaattttttctgcttgatcagcagccaaacgtaatgcttctggcaacgtagatggcacttggaatttaacttgctgttccatctcgttgaacgccttaatgtactggagcttaaattgaagtgctttatcacctgtgaagcccattgctaacaaggtaaaaccgtcacggttcatgtaatacattggatattgcttaccacgattatcataagttcctgtggcaaacatctcgcggctcaattttgagccaccagattccagtagcttatcaatgtctctcatgatatttttgtgttctttatcaaacgtttctgctacttgcaagctactagtaacagcttgcttattcttcataattactaaatcattcatgtggatcattcctttctagttttgttctcttttgggaacggttattgtaaaaaaaattccaagttcatcgttagaaaatcctagtacgctcgctatctttgcaagctcgtcagctcctaagctaacttttccagtttctcgtttggaatatgttgctctacttttccagcccaacatctttgccatgtattcttgtgaatatcccttagcaactctttcagccttaactcgtctcaaatctactgacatttttgccatctcctttcgttctcatttgggaacgattaaagaatatcgcagtcgttcccaattgtcaacaaaatgtctcaaaaaaattcataaagattattttctatattgattgtttccacttgggaacggtgctataatgtgtgcattaactagggagggattatgttgagaacgaacaatgaaatagttgacacattagtaaaattaaaggatgagcaaaatttaacactcagtgaactggctagacgtgtaaacatggccaaatcagcattgtccagatatttcaataaaactagagagtttccgttaaataatgtggacgctttcgctaaagcattacacactactcctgagtacattcttggatttgaaaaagatgaagttgccccactaactaacagcgataaaaaattaataagaattaacaaaatgttaacgcctgatcgtcagcaaaatgtttacaactacgctgacaatcaactgagagaacaaaataataccattgtacgtatgccacgaacgcaaattaagctgctcggtgctgtatctgccggtactggtgaggagttacaagatgatacaaccgaagttgattacacgggcactgtgcctgaatacgactacgccctacaagtcaatggtgattctatggagccactgtttactgaccagcaaattatatttgttaagtattcagaggaagcatttaatggtcaaatcgttatagcctatgttgatggtaaggcttacgttaagaagtatcattgcaatggatctaagtgtgaactggttagcttaaacagcaaatacgacccaattgatgttactggcaacgaaaactttaagataaagggtgtagttgtactttaagtcccctatgtgggactttgcttatgtgttaaaaagaacacacgttctacatatttagcggtattatacttacataagaccagatacggatgtcggtaaaagctagaaaattggaggaataaatatgttagacgctttaatgacgatatcattacttagcctttttatgataccaattgggttgatttggcttattacttcttttgtaatgaaaaagaggaaagcaattcctatcatcttgatgactgctggaatgctattttttttaacaggaataatttcgtacaatacttggaacaaaacacaaccagtgtctgaaaaaaccggtaattatacaatttacccaataaaaatttcaaaagtaaagataaatgataataattgggaaatttatggatcaacggaagctcctaatggtagcagagtttttgcaacaacatttaactctgaaaattactactatctaaaacaactcgtagatactgatttatataacgtaaatgtaagaaatcataagtataaaatcacgatcgatcccatagatgcaaccgatgatacttcctataataaaactaaaaaaattccagtttacattgttgctattggcaattacgacggaaattcaaaagtatcaagtagaacaaaaaaagtcattaaaaagcattttgggcccgctaagtttcatttaactacaagtcaaatcgcctactataatagcctaaatgataatgacgattcgaattcatcaagtagtgaaaccgacagcgatagtgaattgtcaggacagtccaattcaagtagcgttgacaaagacgcatcatcagcattcagcaaatctgtttcagaactagcaaaaaatatcggaaattctaataatttgcctatatcagcaaaagttagtgataacggtgcttcggtcgtctactatgttccagaatcagcaagctcaatgagcaaagatgataaatcgacactagcttccgacttgataccaagaacagacaaacttgctgatatgtgtagcgttgatcagccaactgatatttatatacaaaccgccgatacttacaagacaattgctaaaacaactcttaccggaggtacaaaagtgtactaacttatagaccagatacggatgtcggtaaaagctgggaaattggaggaattgtaatgggactactaataatgattgtcatctttctagcactatggaagatattaggaacactaggccacatctttttgccaatattagccgtactatttatcctggcaacctggattccttcacaagcaattgttatggtgatttgggtgccaatcgcgatattatattttatcggcttagccgggtataaacatgctaagtagaactagtataaacatattttaatcgggggaaagtcatggaattgcgtgtagggcaatacagcgaacacgtgttcgatattaacgttgtagtaggtatcattttctttatagcgctagtcgccattttagcttactggattcacaagcgaaagtagcaccctcgcccactaccagcctagcgggcaacatgcgagcgtagttcaacggtagaacaatattccaagtcttgaagcccattctttcttggactactatgcaggttcgactcctgccgctcgcattgtacgttaatagcaaataattatggaggcacctatgaatattgatatcacaaaactattagattggggattgatagtactatctctttacttagttgtggatacacttctgcaaacaaatcataacaacccctacaacatgtttataataaccctcaaattaatagttgccatcatcgtgggattatttggtatgtacacaactttttacaacatctattgaaacttctgttaacatgcgagcgtagttcaacggtagaacggtactcctttgagttgctgactagatactatgcagatgcaggttcgactcctaccgctcgcgttgaccaaatactgatgtcattaaaagctgggaaattggaggaatagaatatgtacgaccctaatcatgaccctatgataagctcagtttttattacaagaaataaagaaagagatcccatacttgtctatcaggtcgataacaacggcctttatattaatgttcatgttcagtgtgccaatctaaagttcggaaaacatacctttacgcttagcgtgaaagataaaaatggcaaagaatatttggaagacaaaaatattgaaattgaaatcgctgatgatggtacgacacaaagcgccaattcggcaattgcagaagcaattttgtacattgaaatgacacctgaggagctttatggactaaaccatattataataagtacaaaggtcgatgccagtgaagctcctgaattaaacagcactaacattttatatttgcttaagggagatgtcaacaatggctaaggctggtacgccccacgaaataataaggccgaatttcaattctggaaacggaggtaatggtatggataatcaatatgtaacacacaaagagctcaaaaaagcgctaaaacatcagagccacattatggacgtgcacttttctaaactcgaaaaaaatatcaaccaacaatttgaaaaacagtctcaacaatttaatcaagaacttgaattagaaatcgcaaaggctaaacttagcgcaatcaagtggttaattggcacatccctagtacttgctggtgtaattgttagcctaattaaatatttgtaatagactgctctcaactagggcaacatgcgagcgtagttcaacggtagaacagcaaaagtcatacaaggtttcctgctttcaacaagcatcacgcaggttcgactcctgccgctcgcatttaaatttttgaatataaaacttaacaattattggagatggttagatcgatgaatttcaattggaaatatgctcttgtgaataatattgacttttacccatttttcatagtgctggcattggaggaaacatatccaaaatcaatatttgcagattcactatggatattgccagttatctttatattttcattaatagcccattttactctatataaaccagctattaaaagtaatccttcacttgatcagaaacattacacttcaagcctactctcgtggctgataatgatcgtaggagttattggaattatatttgctgttttctactatcattttcattctcctttaatgtggattgctttgttggcattagttcttttaagagatacattcgctaataacgacctgtaaggagcaaaaaagcacatcccctcccgccaagaagatggatgtgcacctgaactattacgcagggctagtgcgccctttcagcccttctagtatatcacaaggaggaatttattatggcacaaattaaacgtgtgaaaaaaggttacctagtaagaatttcgtatagagatcatgcaggcaactacctaagtaagcgaaaaacattcacccgtaaacgagacgcagaggaatttgctaactcattcgaagttagtaaattttctggtgaactagaaaagaagccatctattgagttctctaagtatttctattcgtggtatgagacttacagcaagcccaatctcgcctatatcacaactcgtcgatatgaattagtccatactgaaatagaaaattactttgctcatgcacgtattgcagatattactcgtaaggattaccaaaaattcatcaaccaatatggcaaaaatcatgcaaaggattcagtgaagaaactgcacaatctaattaaagcttgtgttggcaatgctgtttttgaaaaagatgttgaaactgacttcacttataacgtaattatcacttatgacaaaaatcgtagtcttaagattgattacctaaatctagctgagattaagcaactaacagcttatgtacagaatcacctcaatcctcgttacacgtcacaatacatgatcatgactgccatctttaccggggcacgattgggagaaatcatggcactaacttggaaagacattaattttacattcaatactatctcgataaataaatcatggaactatgttgaaggtggtgggttcaagccaaccaaaaccgaaagttcaaatagaaccatccgtgttaacaaacaatttttagatagtctgaaagcacttaaggtaaataaccgagaaatggtatttgagaacgtttcccatgacatcccaacctctaacggcgttaataaagttctgcgctctgacttaaaagcattgggcatcacacgaaaaggattccactttcatagtctgcggcactctcacgttgcgttcctgctctctcagaacattgacctatacattatatcgaaacgtcttggtcattctgatattggcaccacgtcccggatatacgcatacctaattgatgaatataaagcacgctcggatgaaaaaatttccggctctttagacaaactttttaatagcccacaggctgaaaaagaagcgaaaactagtattcatttttgataataaatatccatttaattgcataaatagcaagtataaaaaaacgcgtttttttaaatttgtctttgcttgtcgctgacgtcttcaaaatgctattataacaatattgtctatgtctgcctggggcataattagtctatgagcaataaaagagccgcggtaaacacttatttactgggctcttttattttgtgaattttaacaaagtagtgcctttgcaaagatttttacgcatttcttcaataaggataaattcataataattttgctcaaccgataagtgctgatccacctcacctatccgttagacacactaaccacggcaaacgggccgtagctcccattgttaggggaactatggccttttactaacggttaagtaattgttggtcacagtagaaccttcaccaacacttcagaaactgaggcgattaatttctgaaaatccacaaaaagtcctatgcaacccacgattttagtgtatactagatatgttgacgaaaagttaacgtgatggcggtagtggcgaagtggttaacgcaccggattgtggctccggcacgcgtgggttcgattcccacctaccgcccttctaaaaaaagcacgtgcaattgcacgtgcttttttatttaatcaaatttttctaatcacgccttcagccaagccttcaaagcggctccagtgcgtgaagtgggcacgtcaactgctgctcgtggggttccgctatactgaattcggccgccatactgaccagcatccggccccacatcgatcaaccaatcggcctggctaattaccgccagattatgttcgataataatcaacgagttaccagcggccactaaggcatcgaataattttaataagcgttgtgtgtcttgcaaatgcagaccggcagtcggttcatctaacaagtacaccgttccctgcttgcctagctcaaccgccagcttcaaccgttgcagttcaccacccgacaaagtggtgagcggttgcgccaatgttaggtaacccaaaccgacccggtctaaattcttcaatggctgagccactttgtccatcgtggcaaaaaaagctaacgccgctgtgactgacatctggagcacgtcggcaatcgtcttaccctggtaagcatagctgagcgccgtttcattataccgcagcccatgacacaattcacatgtctgcacaacgggatccataaaggccatattcgtgatggtcacgcctttacccttacaccgcggacaagcacccttaccattatagctgaaccaactagttgccacgccattggctttcgcgaatagttgtcggatttggtcgagcactcctaagtaagtcgccggtgttgagcgaatattcaggcccactggtgtctgggctaaatcaatataagccgtctttaattgccgttttagcgcggtaaccagcgaactcttccctgaaccggccacccccgagacgaccgtcatcacaccgaggggcatgtcgacactgacatcgtgcaggttattttcattaatatggtgtaatgccaagtgggcctggactggtcgttcttgaccccatttatgcggttgtcgcaaccaccggcccgtcaacgtatcagaagccagtaactcgtcataagtcccggtaaaggtcacgtttccaccagtgcgaccagctgcaggccccatctcgacaacatagtcggctaacgtaaacatggctggattgtgttcaacaatcagaattgtgttacccttatccttcagcttcgttaacgcttgcttgattaactgaatatcatgtgggtgcagcccaacgcttggctcgtccaaaatgtagaccatatctactaaggcgctggtcaagtatttggcaatcttaatccgttgcgcttcaccaccagataaagaactggtcccacgatccaatgtcagatagcccaggccaatatcgaccaacgattggatcttggtcgtcagctcccgcacaatatcttgggctaacggcgcatcaatcgcttgtaaaaatgccagaacatgctttaaatccatcgccgtcacctgagcaatgttgaccccgttaatatgattggtcaacacgaccggtttgagtcgtgtgccatcacacgttgggcacggtttgcgcgtgacgatcgccgcaatcgcatcgcgatggtgttcggcttccttcttaccaataatcgagcgcttgatccgcggaacaacaccttcatacagggccgttctaggaaaaccttctccaggatgggctaatttctgttgcggtgcgtgcatcagtaaatcgtattccgcagcactataatccttgatgggtttatcattgtcaaacaaaccactcgtcgcataacggcgccaacgccacgtatccggtgcaaaactcacaaacgtgatggccccctcatttaatgatttctcaggatcaatcaattgctgctcatcaatatcgtcaacataacctaaaccttggcaggttgggcacatgccttggggtaagttaaacgaaaaactgtccgaatacccgataaacggttccccaacccgtgaaaacaagagccgcagtaacgaataaatcccagtataggttgccaaggttgaacgcgcattcttgccgaggcgttgttgagcaatcacaatcgcaacgggcaagtgctcgatatgcccgacgtgtggttgaccatacttcggtaaatattgttgcgtaaaactgggaaacgtttcattcagttcgcgccgtgacgccgctgcaatcgtatcaaaaacgagtgacgacttaccggaacctgacaagcccacgaacaccgtggttgcatatttaggaacgcgaagactaacgtgctttaaattgttttgggtagcgtcgtatacgtcaatggcgccatgtggaaatgaataactggtcatcaaaccttccttcctatcacttgtttgctatcaaaaaaggacctgaaaattcagatcctaagtatcagactgattcatcaacgagcttgacgaccgtcccatagccggttacgatcaaaaaccgtggtgcaacactcatctgagcgacttcagtattgaagttcacataaattaacccgtcgccaccttgatcctctgccttttgcagcagtagtggcttgacttgctcgattaaatcgtcaaaccgttcaaactgatcaacaccatcagattcaaacatcaggtgttttgtgacggagacgacgcccttaatcatatgggagcgctgtaaatcaccagttgtcataaacatttttccaaccccctatcactttaattttacttgaaaacgacgtcactcgcaaacgtaaccaattatttgaccacaagtttttaaaggactaaattaatcgtagggagtgatagtttgaaaacagcaacacaacttttacaacaatatacctttgagcccgttaaggataaaatgcgggtcgaacaacacgccttagccgtccaacatcaggatcgcgccattccattcggacacttcaagatccggttgaaaaatattgataatcaacaaacttatttattggaattaaagcaagcgttacagttgaccaccacgtctgggttccagttacgttcccgactacacggggtgcatgtcaaacatgcacaacacatgatgccgaccggttatcacgtattggcatcactgacgattaaggccgccccacgtgacgctcatgaatttgtacatgacaaaacaaaaatcgcctgcctgattccagttggtgatcacgcggccaaaacattgccagcacaagttccactttatgcgttcacggacaaccatcaacttgccatcaatcagcaggccatggcccagttattcctgacatgcattaagtcccaacaacgccaacaggtcaattaattaacccgcttttataaataaatcgttcgaaaacaatgtatttgcgcaatattaattgcatttggcgaattaattgcgtacaatgtactaaaatagatagtaaaggaggcggtttgatggcaaccccaacaaaaaacattttgctcgacgaacagctctgttttgcgctctacaccgccagcaaacgatataatcatttttattccgaagctttagcacctttcaagctgacttatccgcagtacatcactttattggcactctgggaaaagagtccgatgacggtccgggaacttggttcacacgttaaccttgatagcgggactctgaccccgttattgaaacggatgcaaacccaaggctgggtcgaacgcaagcgcgatacggacgatgaacgccaagtcaacatctcgttgtcgcaaaaagccatcgatgctaaaccagagatttttgcccacgttaattcttgcatggatttacttggtttagatgaagcaacctataaccagattcgcgaaacggttaactttgcttccgaacacatcaaaaatgccgatcctaaaaaggtcgactattctggtgaagcattctaactgactgcttaactaggtcgaggtttttctaacctcggccttttttgttgcgattaaaccaattgatttttgacactagcgtcactttgttttgagactagcccgttcaaggctaatatgaacaatcgttagctagcaccaatcaaataattatgggtgtttgcagccacattaattccgcaaaaaataaatcaaatgataaagcccagttgaatttgatagtttagaccgctaaaaataatttaagtatgtattaagggacgattttttgcaggtactgtattcggtgactttggggacgtgcaacaaaaaaatgactctaccgcttagtagcagtagggccaaagagttaggtttaagtacaatatgggggattgtacttgctcgtccatccactttgggggagtaaaatgaacaagtgtataactattaggtacaagtatatactattacataattgtgaagaaagtgtgaagatttgtccgaattatgcttttttattctttatttttatagagcatcaaccattatttctacaattattatatttttagcattcaaccagattaatatcatccgcttgtgcctggcatcgatgcctttctcagatttgcaaatccgtgtcgaaacctgaacactgcggtaaaatcaaccatgggaggtgaagtccgatggaaattattgaccgcggcttggggtggctcggacgcgtgttgctcactgctggcctaattgttggggtcgtgatcccaccaatgttacttaaattaattaaccaattatatcgccagcatcagctcacagcctggcagatcaccctggcaggtgtctatctgctaatttttgtgatcctagcactggcggcaaccgccctaatgcggcactataccggcaactatcaatcagaaaacttacaacaccatgactggcaaattattggaatggcctatctcaccatcttaatttttgagggcggctttcaatttataaaccagcttctgtatcaccagaatcaaacacaaaataacaccgccattaaaaatttaatggccggcagtcctctgtcactttggcttatggcgttgagcgccgtttttttgactccaattgttgaagagttagtttttcgtggcgttctgactaaccttttctttcaacaagaatggctcaaggtcgggctcagcgggattgttttcggtagcctccatagtagttcaaccttaccgagcttcctcatatacgtcaccatgggactcgtgctagctattgtttatcggctgacccgtaagattcgcgcggccattgcgctccactttgtgatcaatagcctagcaattaccatcatgttactgcattgacgaccttcacgcacaacttcgtcacggcactggccaccctaacttttataactcccctgccagactaataacacgtcaaaaatcaaaaatagcacattaaaatgtaatagccaccaattcatcaggcctttctcacgcaccattcccagaattgccaagccaatgccaataacgggaatcaaacctccttgtaacaaccgataaatcggcaagtaggcccattctgatagcaggattggtcccgttaactgacccaataaaataaacaacaaaaataccccgatattcaacaatgagcaggcaaacgccgtctcggtaatggtgcccatcgcgaggcgaaagtgaaattgaaatcgtaaaaccagtgtcccgatgattccaatcaccaaaataatgccaaccactaacatacagccacgactccttttcttgtcattgttactgtacgctaaaatcaacaatgcgcctagcgcaaaactagaagcttaatgattttttagcaaccccgtaacgcgactaacaactaaataaattcgagtagttcaccgtagcttttatatggcacgctgtcctagtcattaaccatcaaaaaagagccggcaacttgcccgctcacccatctaactctttgtcccggttggtactgttagtactttggcttttagccccacgactttaattgtaatccgcttatgaactggcattttaacatagaattgaccactctgcttattcgaaataacctgacggacatgtttcccactctttaaggtgacaatgacaccgtgcttggtacggccactgattgttgcagaggtagcattttgatggtaaaccacctttgacacagtgagccgatgaattcgtcgatgataatcaccttgcaagctgtattccgaaccaaatattaacaaacaaccggccaaaatcattaagattagtgaccagaactgcttcatgacgccacctccagaccagctcccacagctggcatttaatagtctaagcatacatgcaaattaatctaaaaagccaaaaaaggtgcaaagctcataatagcctgcaccaacgtcattaaaattcacttttgattaacgattttgttacattagagtcttaagcgaagctagctaaacgtgactgccagttcggaacgcttgattaatgcgattaaatcatgcattttacgaatcgcaatatcgaccgactcgccattttcaaagtagccaagctgatgttgcttatcaattcgtactagcatttgcgggttcaccaagaaactcttatgaacccggaataactctgggtgggccacggtttcatcactaatcttaccattgtattgaacaattcgatctgttaaatggagaaccagcttattacgaactgctccagtctcgataaataacacctgatctaatggaacattgaagagctgaccacccttagagtaagaaaacatggccttgctggtgactgcttgcttggtataacgttcataagcaacccgaatatctgtctccactttggctttgaccgtttcttgacccaaatctttcacaataaagtccagtggttcgattcgtcgttcaaaggtcaaaaaggccatttcagaatgggtcgacacgaagacaatccgcgcattaacatccgcctcgcgaattcgagtcgccagtgctaggccatttaagtcttgcccaggatattcaatatctaaaaagtagagtccctcaagatcggaattggtctcgacatagtccaacaacgtttgtgcttgtccggttgctaaggtcagttccatatcaaaatcattaatcataatatgattcttaatgatttgctttaaggttgctaattgttcaggatcgtcttccacaacaaaggtctttaacacgctgctcactcactttcaatactaataataaattcgaatcgttgatgggagctcacttcataagtcacgttagctaatggatctaacaactcacgaacggttgctaacccttgcccatgaccagcacctttcgaagtatgcccagcaaccatcagctcatccaggcgctcaatcggatgattcaatgaattggcaaaaatcaactctatcatgcggggatacttaacaagtgcgaccgcaatctgaccaccactctgacccttcaccgcttcgatggcattgtctaacaagatgccactcacccgtgataacgtcactgaatcaattgcaattgccgcaatcgggtcgttggcttccaagcgtacttgaattccagcttggcgcgcaacggaaaacttactctgaataatggctttcaatggtttgtccttgatttgttctaaattgtcaaagtgtccaaaatcacgatttagactttgcttagacttggtcacaacttgacgaaaatattgttgtaattcaggatcatcagctgtctgaatatactcacccaaggacagtaagatgttttgataatcatggcgaaacttacgtaaattttgataactattttccaaatttttgacataaatatcatattgttgccgttccaaagcttgccggttattttgaacccgcaatgtataactatagaacaggtaaagaaacgttccggcgttgatcagcaagatagccactagaatcaacattagaatccccaaaaatcctgagccaatattataattatccgccgcagtcgtgatggtaaaaaacgcgaccgcaactacagccaaagcactgacaatcacgttcaacgttagcccgtctacaaattgccgcggataacgcttctttaagaccttgaaactagcggcgactgccaacatacaagctgtgacaattgtttcaccgatggcttcaaatagccagccactccagtcattcaaacccaagttgaataagtgaaaaatcgactccgtcgcataattgccaaagaaactaaaaagaatgtaggcgagtgtggccgttagactcgtcacaataaagtactttttgcgccgtacaaacgccagtaaccccatgttcacaatgaacgtgatgatatccgaatagtcgtcatacaacatgtagatcacagttagaagtacggtcataaccgcaacagtcgcatagactcgcttctgtcgaagctcacgattgattaatatctgcagtaaaaaaaccaacatgaccgagtaccaatggtcaaaagctgcaatataccaatagacgtaaacgataactgctcccctccccgcatgatgctcaatactaccattgtagcgaaatacggccagtttgtatatttgtgcgataaaaacttaacaatctttaccaaatcgctgactgaccaattaatacccgtaaccgtctccaaagcttgctatacacgcctttattgtcttaaaagacacacatgatcgacggtataaaaaaagcgacccccgttcattaacggtgccgctcacagatcattattagtgaaaatcacccggcataaaactctcgataaccgcggttgtattaaaggtttcaaaactatggaaactggcttcatcaatttcagcgtagcgaatagcaatttgtgggcgctttgcaagatcgaacatatcaacgtaattaaattcaatatatttcttatgttcactatgaataaagccagcatagctgtcaccatgttttttgattcgaccagatagctgaatcacttgatcgtggtgaaaagcttgcttcaacaatgtttttaagagcgaatgtttagtcttattctgcttcttcagcagcttattcatcaatcgttcagtgttccaaacatcataatagccccgttgcttagccagcgcaatgatcgtcgccatgctcttcaaataatcagtgtcactaattacgcgggctaacgatgccttacgaaagaccactaacccatctagttcaccatcgacattaacggcttggaccagcacaaacttctcatcctgctgaatcacatagccaacactaaattgctcattggttcccttggaatagatttcaacgaggttggtattcttaatcgctttagctaaatcgtcgcgaatcgcactcatgcgtgttcccccattcagtaatttgtaacaaataatttatttcatactaccacattttcaattatcatgataccacttgtaaaagttgaacgccaaatggcaactttcattttctaaataaaatttgtactataaaataaacttgttaataacctccgctaacgcgtcatggttgttatcagcgaccgtcacgtacttagctgcggccttgactgcatcgataccattggcgacactcacaggcaatccgaccgccttcagcatggggagatcattgctgttatcgccagctgcaataatttcatccgccgtaattcccagtagctttcctaattgaaccgctgcggtccccttgtcaacgccagccggattaaactcaacgtaacggtcggacgaataagtgacggctaatttgcttggatcaacaatagcttcaacgtctgcgcgcatttgcttgcggtcagtcatcgttggcaaggccataataatcttcatgacgttcatcgttttgaattgttcaaagtccggcgtcgtcatagttgtgaacgtcacgccccggttttgtagataatctgaatcacttggaaccggattgtaaatatataacgtatcctgcgtgtacacatgcgtcgccgcctgctgattcgcaattcccgcttcaaacacccctttagcaacctcatatggcatggcattcaccgccaatggccgattatccttattctctaaaatcaaaccaccattataagaaatagaatattgatgtggttggtcccgcaatcccatcgtctccaaatcgttctgaaacgaggtataactacgaccagaattcggcacaaaataaacacccttagccgccgcagcttgaattgccgccgcattcttttctgacaacgtaccatcgtcattcatcagggtctcatccaagtcacaaacaatcattttatacatattaaagttccctctcatccgcttgaccatctgaaacttggtcattttaggtttactattccactctagcgaaagacgtgcggaaatgcaaccgctttatttttgcgttgaaatctcaatgtttatccatacatacgcgcaatttttagcacagcgtgcaattataggtgctacagccatttgtgaaatttaacttagtcgtttgttaagacatttcaaaaatgcgacctgctaagaatcaatttctaaaactgaaacagtcaattactgtgctcaatgacccaactttcaaaaaacaatagctttatatgattacgaaaaggtaatcgcagtaccgatgttttaattggcagtatttcttcaatatgttgttaaagccagtacttttgatattattgattgcttatcattccctactgattaggcatcgtacattgacagggtttgctgggaacaggtgccgtgatatggtgaggtaaattcagtatcataattgcacccacaaccaatataataccaaccaaggcctgaggaaccaagatttggtgcaagaataacatgcccaaaagtacggaactgattggttcaaatagtccagtcatagttgccagaaatccgtctattagctttaaactttctaaataaagatcatacgcaacaacggtggctagaataacaatgataagaaccgctaaaagctgcgtttttgagaatctaactaaatttggtaacggtgtgtgaatcaacgctatcacaccgccaataactagtgcccatcccaaaatatccactgcggcaatttggtttaacaatggaacaggtagtttggtgtataagataaccccgatagccgcaatcaggccaaaaataattgcttccggttttattaatccggtcttaaatccggattcaacaataagccagattcccatcaatgcgcttattaagctcattcctgctaataaactgggaagttttttcgctttcagcgcggtaaatacaagcagaataaacggactagtggactgaaagacagttgcaactgctgcattactgtaattaatcgcagaaaaaaaggcaatttgtgccgtgcacaagccggcgatgccgtatatcataattcgtgttaaaattcgccaatgtgtccaaatctttttcgtgctttttctagcctgcttgaaaaacaagttacgatatagcaacaacattgccccaccgattaacagccgtaacaatacaatctgttgtggagtcagaacttgctcacttaacaaaggctgtgctagtattccacctagcccaaataaagcggcactaataataccgcacagagttccaactaaacgcttcatacaaaagtttctcctctataatagttcaccattagaaatagcaacactttgattgtggtagtcatcattaaataaggcattggctgctgccctagcaaacgtatctcgattaattgcaaattcagactccggtatcgctctaaattcaggaccgtgcgtaataatttttgtttcgggtccattctgaattagtcctggtctaaagattgtaaagggaataccactatttgcaaataacaacggtttgtctaactgatcatgggtatactgaggatgttgcgtgcgaacagtcgataaatagggtaaattaccagacaaatattcaccgtaaataccacctgccgaaatatcgactattcgtttaattgttgcctgtgtttccttaattgcacgtaacaataacttaacgtacggaccagtgctcagcccaccaacggaatcataaatataatcgacatcctcgagtgccgctacataatcagtatatttcgctgcatctcccagaaaaataacatgttctcgtttctgataggccgggacctttttgcgattacgaacaaataattttaaagtcatttctggataatcacgttccattaatttaatgaaggcctgggcagttggcgaagttgcaccaataactaaaactgtattcatcgttcatcggactccttttccatttgctgatatgttttaataaacccgttcatgaatgcgacctgtttcttaagttcagcctgttttttctctaattctttcagatgatgttcaacaatcgcttgacgcttttccgctgttgcttgcttgccttgaacaactaaatcagttagttgacgaatatccttcaacggcatttcggaatcaataaaaatcttcaaatttttcatccaaatcagattcttttccgtaaaaacacgatacccattctcagatcgtcttagattaggaattaggcccaggcgatcatagtaatggacctgagagacactcatcccaactaatactgaaatctcttgggttgtatatttggcgacttcatcatccaattttagttcctccttttttcgcatgcgattcattataaactatcaaccatacttcatagcaagcttttccaatcaaattggacttgggtgaataatacccacaataatagccgccatttttgacgtcggccaaacggtgcttataactaagatgcaactaacgatcacatcaatatcatctggttgcatttcttgttagagtagcttacgacagggtgatagaaaacaaatcataacattatgtgctaccaaagcaccgtgctaaaatcaaatcagtcaaaatgcaagtacgtgctaatactcggcaaataagccagttaaggagacaccatgaaaacaaaacctgaagccttaatgcgcgacttatacaatttaatcatcaacccggcgacgcgtgactgggaacgccatttactagtccaggccaagaataatcggcaacagctatcgccgactgggcaactaaaacagctcgaagctgatttgcgaccattagctatgcggaataacttgaccccggatgttatggacttttatcttgccatcactggcaacgcacccatgccgactaaaaacaatgtatcggcttacccaccccttagttcgccttatgaagaacgggcagtctttgctggtgggtgcttttggtgcatggttgagccctttgatcagcgtcccggtattaataatgtgatttctggttataccggtggttcgtgggcccaaccgacctatgaacaagttagtggtcaatatacggggcacgttgaagccgtggaaatcagatacgattcccgtaaaatctcgtatcaaaatcttgtcgatatttattggcaactaattgatccgaccgaccgctttggacaaatcaatgatcgcggtagccaataccggccagtcattttttatgctaatcaacatcaattgaccattgcgcaagcatccaaacaagcgcttgtggactcgcaacgttatcaaaaaccaattgtcgtggccattgagcccttacagcaattttggccagcagaaaattatcatcaggatttttaccgcaaacaaccccggcgctaccgacaactgaaaaaagcccatgatcactatctaaattggttgaaattcaaaaacaaattctagcttggcggttcagtcacaacttatgactttgcctgcttctggaatcaattggtcaagcactaatcgctgtgccatacttaattgttatggaggcgcataaacatgcggcaaaaatcgcaatgggccctaatcagcttgtggctgattatattaggaagtttcatccacatggcttaacagtgatgccggtaattgcttataatctcctgcaaagaccgtttggttgatcatttctgatattgctattattatcaattgaccaagtgttttatgaccacttgatcaatctcgttagtcattcaatcatcaaacattaattttaaaaaacaggatattgacccgccatacgaatgacggccgtccattgtcctgtttttattgcggtattttgcagcatgtcagctttcagtttgacataacggtctcaatcaggacaaaccacaactgcctacttcgatatggtatattattactgtctacatcagatttgccaatctgtctgagtgctatggcctttttctagccacctcacgcaaacactaaaaacaacgaggttctcaccatgcaaacaattcagttaagcaacatctttaaacaacaagcacaccaaacgattttaaaagatttcacactcaccattccagcgcaaagtaacatcggcattcagatgagccacgttgaggcaacgaccctctttaacctattacgccaaacgacaccccaaactagtggcgtgatgactggcctcactcccgcacgtatccaagccatctttcatgatgacggcttttatccgcaattaacagtctcgacttatttgaagacctttcaacacatcagcacctttgagacggacctggatgacattttgcagtatttcgcactcaaagacgtcgcccatactaagatcaagcacttatcctttgatcaacaacaacgtctggccttactgcgggcattcatcctacaaccggacttgttgctaattgaaagtcccctgaccaacttgaccaacgctggcattgagctgtacttagcagccttagcctatactcgcgaacacggcgtcaccgtactgctgacctcctactcattagaagaacttgtcctaaccagtacgactatctttcgttatcgaccaaaccagggcctcgagttgactgatttggcgaccgaaagcagttccgattccgcacacacttcagaagatacacctagaccaatttttaaaattgcaagcaaggttgaagataaaacagtctttttcagccctaacgagatcgattttattgaaagtgtcaacggggtcagtcaactgaacgtcagtggcgaacaattcacatcatcgcaaacaatgagcgaattagaacaacaattgacgacgctcggcttctttcgctgtcatcgttcttacttggttaatttacaacaaatcgcggaactaatcagttactcccgaaatagttacacgttaatcttgaaaaacaaaagtaaactgcccctctctcgcggtaaactcactgatttaaaagctttgatcaatttttaggacaccattcagcctaaataatgcaccattcggccccaatatgccccattacaccttgatttaatcacattcgacgattgctccagtaaactagattttgtagaagccactacgcttccaaatcaaatttaaaggagtcagcgatcaacgatgacaataaaaaatgcaatcgaagtgattaacattgccaaatcatttcaaaatacgaccgcgctggaccaagttagttttaccgtccagccaggtgaaatttttggctttttaggtccctcgggatcgggaaaaacaaccaccattaaaattctaaccggacaattattaccaacgaacggtgaagcctacgtcctgggtcagtctgtccaagcatacgacgaacaccgctatgaaaaaatcggcatcgtcacgcatcaaagtgggctttacgacaaattatcggtataccaaaacctactattcttcgcgaaaatgtttggtgtcccggttgcacgtgttgataagttacttgaacgagttggtctcagtcaacataagaaaaaactcgctggtaagttatctcaaggtatgcgtcaacggctagttctggcccgagcaattcttcaccaaccgcaagtcttgttcctcgatgagccaaccagtggtttagatccccgcacgacccaagcaattcacgcactgattagggaattacgcgaccagggtacagcgattctgctaacgactcatgatatgctggaagccactcgtctctgcaatcgtgtcgccttactcaacgctggccgcatcgcagaatgtgcagccccacaagcattgcaattaaaatataatcgcgaccagcagtatcgcgtccacattgcatcggcagcgcaagatttgttactccccgcatctcctgagacgacctatcagattaatcagtggatgctttctgggcaacttgagacgattcactcgtgcgagccgacccttgaagatgtctttttaaccgtaactggaaggagcctaaaatgagtttatcagtaaccaaaataaaagccttattcggtcttaaattaagactgatcatttcaaatatgagtctaatgactgccccaatcatggccattttgtacgtcgttttcatgaagagtattatgcaaagtaaagcaccatcacacgtcgctctgatttccctattactgggaatgggactatgctttaatatcgttatgggtggcatcatgatgacgagttatcccttagccgaagaaaaagaacaccatacgttacgtgtcctaatgacctcttccattaccgggcccgaattttttatcggtagtttattgccaccactagctattatgactgtaaccaatttgatactggtccccctaagcggcgccagttggtcgcaaattcacttaggaaactttttattgattactattatcactagtttaacgagtctcgtgctcggatacattattggtctgattgctaatagtcaaactcaagcaggcgtctacagtattccaatgatgctgattttaagcctgataccgaatttcgaacagttcaataccacccttaaatcctttagcagttatctgtatagcagcacgcttaatcactatattaccgcctcgtataccactggtggcttttcatggacgcttcgtgaggtactgacgcaactcggatggctcgtgattacctgtggcatcttcttctatgcctaccgtcgtcacggccttgataatgactaaaatttaggaggttttcaatcatgtcaactttaaaaatcggaacgaccgtcaagttaccaaaaccatatttgggaattgtgggaacgatcattgcctactacgcagctaaagatcaatacttagttcggtttggtgttagccaacaactctacttcaaaccagatgaactaattgtctggaaatcttaactgcttatctcataccaagccccttactttgaaatatcatggtaaggggcttcttttccacgttcggacaatcccgcagccgaatcgacgttggctatgttatagcaattgccgctcagcctagaaggtgtatgtaggacgcacatttactgatgaccagtaacctaactaacacatttttatcataattgatgacagctcaattcatgctatgtatacccataatatttttaaaatcataacttacccttaattttaaaccccacttgcactcaaaatggtgtttaaaccccacatgctgtcttgatgatgtggtgctatttctgaaacctgttatcctctttaatgcacacacggggtttcatacaaaatagacaattaagggagcgcaagtaaagatgattaaagcagaatgggcgtatatgcgcaaacacaaactaatgattatcgtcatggcaatcattatgttcattccatcaatttatgccgtgacatttttacgatcaatgtgggatccatacggtcggttaaataatttacctgtagccgtcgtcaatcatgatcagccagtcacgtaccaagggaagcatctcagtgttgggcgcaatttaacaacgaatttaaaaaaatctagcgctttgaagtttcaacaagtcaacgcaagtcaggcacaaactggcttgaaaaatggtcgctattatatggtgctcacgattccaaccaatttttcgcgccacgcgaccaccttactcaatcaccaaccacaagccatggtgctacattatgatacaagtgctggacataacttcgtcgctagcaagatggccgattcggcggtcacttcgattcggtcatccgtcgcccaaacgattacaacgagctatgccaaaacgatgtttgccgctatcaaacaacttgacagtggcctcaaaacagctgctactaataatcaaaagctagccaccggtggtcagcagctccaaactgccaaccaaaaaatcgccaccaacctggacaccctcgcaactagttcgctgaaactaaaacaagggagtcaaacactgacggtcggtttaaaccaatatcttaatggcatttcacaactacaggtgggtaaccaaaaagtagttgccggtctaacacaactgctcgtcaaaagtaatcagttagttgctggcatggctcaactcaacaccggggttcaaactttaaatcaaggtgttgatcaatacgttgctggcgcccagcgagtgaatactgggactgtcaaagtcaatactggtgcccatcaggtggccagtggcacgcaacaattcagtagtggtaccgctcaactggcgactggtacgcaacaacttagttccggtttaaacgcttatgcggccggtgtcggcaaggtcaacactggtgccaacaagcttagtcaaggtgctaatcaactacaagcacagaccgctcagttaacggctaaaacgacggccctaacgagcggctcaagtcagctaactactggcatccagacactaggtcagaacagtcagtccctcaccatcgacttgcaaaaattgcagacgcaacttaagcaaccaaccaacaatcaagccacgattagcgcaaccgtggcagcgctgaaaaagcaggctgctggtaccgacttatcgtccgttaaaaccgcgctaagtgcgctgacatcggctattaaaactagtgcggcgcttcacgacaatgtcgccgcaaccgctaacagtcaaaatttgactgcggcacaaaaatcagccattttgacaacggttgatcaatccgctaaccgtgacgccatcaacgccgcccttgcgagtttaaccacggccatcgcccagtcgacgcaaccggctctagatacgactgctttgactagggccctcagcgccacgactcaacagcaggctgaccttgtctccacggtcacccaactcactaccggtgcgcaatcactgacgaccggtattcaatctgctggtaacgcggctaacaaactgaggactagtctaacccagctgaacacggtcctacctaatctcactaatggcattggggccgtcactactggtgcgacaaacttggctagcggaacaacaacgctcacaactaatagccagcagctcacccaaggctttaaaacactggatgctaacaccaacttgctcaatcagagaagtcaccaactggctacgggtgcggggcaagttgccgcgggttctcaacagctgaccgcgggcacgcgtcaactcagcacccagggcaaccagctaacacaaggtgccagccgcgtggctacgggtcttcaatctgcacagaccaacctacccagcttaacaactggcatctcacagttagttacgggcagtcaacaagtcaccactggcttacatcgactcggcacaacgggtattgcactcgctaatggcagtcagcaactcactagtggcaatgggcaattagccaccggagctcagcaactagccgtgggtgctaaccaagttacaaccgctggtaataagattcaaactggtaaccaagcattagcgaccaaattaggaacggccgcaagcaaggggaatctcaatccatcaaaactgacgtatcaacaagttgccaaacccgtcactacaactcaccaggaccgtgatgatgtaccaaacaacggtactggtatggcgccgtatatgttaagtgtctcgttatttgtcggcgcgctcgccctcaatatgatgtttgatatgtataccccacgcaaacacccgcaatcggcactggattggtggagtagcaaggccagcatcatgctcgtcttttcaatcatggaaagtacgattatgctcggcttgatgatgttaatcaacggactcagcccgattcatccgtttgccacttggttgttactcacgctaacggcgctactcttcatgacgatcgtcgcttggcttaaccttgtcttcggcaaagctggcgccttcttcagtatggtactactagtcttacagctcggtggttcagccggaacgtatccaattcagctgtcaggtcactttttccaaacaatccacccgtggttaccaatgagttacagcgtcaacggcttgcggcagaccttaatgactggtaattctgctcttcctgagatgggcgtcttagcactgattctaatgctgtttattgctctgacctggttgttctttatccgtcgttaccctcggctggctcaaattgactttgaagaccccgtcgccgtcaaagccactcagagtaagttagccacgttggttcggcgaaaggctcaagctaaagcatctgacaataagacgaattagttatttggatttatgatctcgaaacactgccaaaacgactttctctatatcagagagagtcgtttttagcagctaactaagttgacgactttacccaaatggtgctgttaattctgattcgctggtcaacaccttaacctactaccatattattagtattcgtgaaaatccctactaatattgaaacgacttccccatcacttgagactgcttttcacagactcattttgaccggatgtcacacacgctaagtcacctaacttgtcagtcaacagcccaactagctaaaaccattaactagtctcaaatgcaccacaacaatcattcagaacaacattaagtcactatccaaacaaaactaatcatgataccacctcaaattagtatgggtatgctttagttagggacaagcttacggttaaattagattggtatattgattgagtcagcgtttgattttggctatactgttaacagtcaattaataaaggagtgcgagtcgcatgatcaaagaattcaaggaatttattgcccgcggtaacgtgattgatttggccgttggggttattattgggtccgcttttacggccattgttaaatcgttgacagacaacttaattaatccactgattgggattttcttaggcaaagttgatttatccaatctaaagttcagtatcggtgatgctacttttaagtacgggtcctttctaaatgccatcattaatttcttcatcgtcgccatcgtcgttttcattctggtgaaaattattaataaagtggttaaaaatgaaccagaagaacccgaggaagaagaagtcgatgtttccgcgcaatatctagaagaaattcgtgatttattaaaggaacaggctaaaaaataaatgaaaatagctcccaagcaaatttttcattaaaagtctatatggtattaaaactttttttgagatacaatatattgtgcaattttttataaagaggggctatcatggtgataataacagcaggaatgattggggtcggcaaaaccacgttaacggggttaattgctgaccaccttggaactaaggcattttacgaaccggttggcgacaaccccgtattgccactttattattcggatcctaagaattacgggttcctattacaaatctatttcctcaacaaacgttttgcaatgatcaagaaggcattggccgacgataacaacgtcctcgaccgctccatctatgaagatgccctcttcaccaaagaaaacaacgctgaaggaaacatctctgatactgaattgaatgtttacttgcaactactagacaatatgatgaccgaattgactgaactgcctaagaaggcaccagacttgatggtctactctgaaactgacttcgatacgattctttaccggatcaagaagcgtggtcgcgactacgaacagttcgaccacaaccctgaactggaatcttattactataagatgtggaccgcttatcggaaatggtacgatgaatacgatgctagccctaaaatgaagattgatttacaacagtacgacttggaaaaacctgctaaccaacaagcagtgctagctcaaatcgattctgaattaggtaagattcgcaatccaaccacagtttaattaatcatgctaaaagcgccagtccccattatcgggactagcgcttttattgcgcacaatctagcgagcaaacaatacagaaacttcttaatgactcgcgaccagctaactaggtagcgcgggtagtgtcgcattaccaaacgacaatctttgaatgccgcactagcacaattgcgctcgattacatggctgcccggacttgttgggctaactcaaagttattggtaatcaccgcattgaccgaggctgcgaacaattgttgcattacgcttggctcatccactgtccaaacccgttcagcaacatggtgtacaggttgatagtgttcaagatgcaccccttctaagtgttcgtgagtcgcaaactcatccggattacccagacgcgctgaagtcaaaaaagcatatttctggctggcatcaatggcgtaggcccgctgtaagctcttcagattaaacgacgaaaaaacgaccggataaattaagtcagtctgccggaccatccgtagcacaatccgctcgatatcaagataatagtgtcgatcagtcttcaactcaaggttcaagtgaacgggctccccactcactaagtttaaaaattcttgtaaggatgggacgggctctccatttgctaattcaaatctacgcaactgttcgaaggtcagatccgcaatagccccttgcccattagtagttcgatcgattcgttcgtcatgcataatcactggtattgatcctgggtaagatggacgtcaaactctaagccatcgatatgatgactgatggcatacgcaaacccagctagcgaattctcaggaaacttaacgggaacgccccgatgaccataaatcaacgacatatttggcacaattcttcaactctttccaattaatgacgaccgtttgcacggttatttgattctaacactttattgtacgtattttcagccgtttgcaacgattgtcgaatatcttggcctgcaaaaatctgctgcatcgccgtttgaatcgccgtccgtgcgggaacccaaccatcgacaaagacacctgagttcgtattattaggcttcgttcgtagcatctgattaccagaaacttctaggaccggcgacttcttgaatagttttttcagcgttggctcgtccttagcccccttattaacggctaaataaccagtcttggcttgccaatcggcttgcgtctgtgcgctagcgagaaacttagtgaattcccacgcgccatcttggaccgcgcttggtttatcgttcgcaatccaaagtgccgccccaccaactgcgattccgttggctctctgaccattcggccgtgggaaatatgtgacacctagatcatttttgagcacttgatacaactgacccgtgttcgcggacgattgcatgaagatacccaaatggcctgccaagaaagaagctgcttcatttgcagcagcattaccacccgaaccaaagttcataaagtcaccatagtcaatattttctttaacccacttcatcgcattgatcgccgcgggactcgtaaagtcgaccttagtcgcattgccagtatgaccattatcatgattggcaacgggaacacctgcgttagcgactagctgctcgaatagccacgaataggcctccattgtcattcccttgactttgccgtgggatttgtcgtggatggccttagcgactcgcgtgatatcatcgtaagtcggatccactggtggcggcgtaatcccgtactgacgcaagaccctcttattataataaagcgccgtttgcgatgcattaaacggcattgctagcaattgattgtcgcgcatcacgatcgccttggcgcccggaatgatttgatcagcatcgtaatggtcacggtcaataaatttctgcatcggtgtcgtgaaaccactgtgatacatctgactggtggaaatatccatcgattgaaatagcgctggtgacgcggccgtcccatgcgtattcaagattttttgaatgacgccattatagccaccctcaaactcggctacaacttcatacttggactgttggtgattaaacgctttaacgtaggcgtcaatcgcttgttgaccaggacctttcatctcatgccaaaacaccactttaatgcgactactatccgcatggacacgggtccgactataagcgaccccacccactaccaagaggacaaccatcataccggctagccactgccactttcgcgttatcttcatcatttcaccgaaccttcattcaatccagatttaaagtagtgttgcccccagaaaaggacaatcaatgttggaatcaccacgatggcggcactcgcctgaacgagtccccaattcgtagcggtttcctccgaatgcaattgccgcaatccatcttggaccggacgtagccgatttgaaaacgtggtcagcattggccataaatattggttccagcttcctaaaaagctgtaagcagctagcgtcaataaactaatccgtgagtatggtaaggcaacgcgacagtaaaattgccagtgtgagagaccatcaacatcagcggcttcctttaagtctcgtggaatttgcagaaaggcttgacgtaacatgaagataccaaaggccgaagttaagaacgggataaccatcaccgcatagtgattcaacaagtgcatcgcacggaccgtgtgaaagttcggaatcacttcagcttcaaatggtagcatcatagttgccaagaccaagtagaacaacgcatcccgatacttaaattctaaaaacacaaaggcgtaggcggcaattgatgcaaaaaacagatgagcaatcatctgaatgatcgaaatcactaaactgttaaataagtagcgaagaatgggtgttttggtaaacgcatcctgatagttctgccaagaaagggttccgctcagtgatcctttcgcaatagtcgtcgttggtaaaaagctggtccacaaccctaaaacaaacggtaaaataatgactaacgttaatgtaattaataacaagtaccggaatccgataccgattcgatgtcgaatcagggcttgagtagccattgtattttccattagtaatgcacccgctttgctaaaagtttgaattggattaccgtaatcgctgcaataatgattgctagtatgatcgattccgtgctagcaagcgcatagttaccatcaacgaaggcatcccgataaatacggtaaactaataagttggtggcgttcgtaggcccacccgcagtcatcaagtcaatcaatccgaaactcttgaacgctgagatcaacgtaatcaccgccgcaaagaagagtgtgggggaaatcattggcaacgtgatatggatgaactgataacgccgactggtccccgccacatcggccgcatcatataaggttttaggcacaacttgcaatgccccaaaaaagatcagaaaagtaaatccgaggtgcatccaaacgctcgtcataataatcgccaccatggcccagtgtggctccgttaacaaattaattgccggtaagtgcatccagatggccaccttattcaacaagcccacggatggattaaacatgaataaccagaaaattgcggagaccgagacagacactcccatagtcgaggtaaacatagttcgaaatagctcgataccccgaaccctttgattggcagcggccgctaacagtaaccctccaattaacgtgaacaccgtcacacccacgacatagattccagtggcttgcagactagcaagataactcttagtcgtcagcaaattaaggtaattttgcaaaccaacaaagacggttggttcaccaagactattagtcaagaaaaagcttagatacaaggtgcgtaacattggatagaaaacaaaaacactgagggcgagtattgagggcccaagaaatagccaagcataatatttatcattacgctttaattcaaaactgtcggtctgcacagttgcttggtcatgcgcatctggcgattgtttcggcttaaggcgtcgcttaatcgacggaaacgagttgatcactagtaacaccctcctcttcagcaatcaattgttcgtgctcatcaaaaatgaagatcttaccattaacggttacattcacccgctgctcaagtggtaattggacctgaccagattgtgcaattcgcaatgccgtcccgttatcagcctgcacttcgataatcgtcatctctcccagtgtctcgacattcgtaaccttgccattaccgcgctcatcagtaactggtactgcgtttagctgattaggtcggataccaatcgtatagctccccgcgtttaatggttggttaagcgcaatctgaaagccctccgcgacgtgtaaattacgagcggttttcgtcaccactggcagtaaattaatctgtggcgtaccgaaaaattcagcgacgaaatgattagcaggatgattataaatatctaacggtgtatcaatctgctgcacgtgacgctcatttaacaccattacgtgatcggccatggtcatcgcttcagtttggtcatgggtgacataaatcaatgtcaatccgagcttacgttgcagttcgcgaatttcggtccgcatttgcacgcgtagttgcgcatcaaggtttgataacggttcgtccatcaggcaaaccttagcatcactggcaatcgcccgagccaaagccactcgttgccgttgaccaccagatagttcgcgcggcttgcggtcacgataagccgtcaaattgaccatcttcaacgcggcattgacccgacgctcgacttccgcggccggcatttttcgtgcttgtaaaccaaacgcaacgttggcagccacgtccaaaaaagggtacaaggcataactttgaaaaaccattgacagctttcgatcttttggtgggactgcattcatgatctgaccattgatggccagctttccactagtaattggaataataccggcaatcatccgcagcagcgtacttttaccacaaccggatggcccaacaatcacgaataactctccgtcttgaatctcggcatttacatcgtttaaaactggctgtttcgccttatcatacgtctttgtgatgttctgcaaggtaattcccatattcatatcccctcgaccttttatttgtaatttattagattactctttaatcatgccagaccaacgtatcgggaatgttggcataatgtaaaaataacgtatgggttatgtatttttttcataaacagcgccccaccaacaaattcggagtgaataaaaaatagttgtttcgagaatttgtacattctcgaaacaactatttagtctgtgtcctaccagttaatctgtcatggatgataacggtccaccttgagtcggttttctctgtgtccgatatcgagcttgaaaaagccgctcaaatgtttatctggacacactatcggatgtcctaaaaatttcaattaaagccgacgagtggtatgctttggcagtttgactggctgttgatcagcatctgtgcgcaccaccaacgtgtcacaggtagcattgcgaatcacataagcagcattagagccaattaacacccgtgccacgttgttaagacctgtggccccaacaacgatcaagtcagtgccatagcggtctggtaaagtcgtcgctaacaataacttcgaattacctgaatgtaagtgaacccgcacatcgctgacacccgcggccatcgcttgttggcgagccttagcgagattcgctttaagaccggccgtcaattcgttcaatgcctgcggtgtcgttgcgccaaaacccatcggcccttgagtcacaccaataaatttctcagtattaatgaccgtcacaatatccaaagcggcattttgctcgaccgcgatcttaattgctttcgttaaagctaattgggactgaggactcgtatcgatgccgactaaaatgcgtttaaccatcgtcataaccatcaccctccattaaaggatcactatttgtcggttgctaacacggcaattgattcagcgtaaatcgccattgcagccattaattcgtcaattggttggaattcattggcttggtgcatcgtatcttcggtatctgggaagagtgccccaaaggcaaccccacgagccatcatccggccataagtcccaccaccaacaatttgtggttgtgaggccgtgtcaccagtttgacgccggtaaacgtccatcaaatccttgacgatcgggtcttcagggtcaacgtaatgtggcaccatgaagtcaccctgcgtgaccgtggcaccagctggtaactgtgcttggactttcgccgttaaatcagcaggttcgattcccttcggataacggaagttcaacgttaacgcaccacccttttgatggtcgaagctgagtaacccgacattcatcgtcaaatcacccataacgtcatccttgtaagctaagcctaactggttcgcccgtgaatcatcgtgtagcttattagccacgaagtctaagaaagcagcggcatcatcagcaaaggcatagttagtcaagaacgttgcaaggtaggttccggcattgatcccgttacgtggttccatcccatgggcggcctttccaacaacttccagcttaacgccttcaggaacgaccgttaattcaccagttactggttgctggtccagaaacgctgtgaagtcggccgccaactgctcgttgtcatccgtcgcgaccacggcttcggcatcacgcggcaccatattttcacgcaagccagaatcaaaagaaacaaggttaaagtcgccattatcttcatgaccgaagtgtaattgcagactcacatttcccttttcaccattgatcaacgggaacatggcatctggagagaagcccaaggttggcgctggttcaacttcaaagtagcgtttcattccagtccaattactttcctcatctgtcccaacgataaagcgaatcttcttattgagcttcaagccaagttctttgacaatctttaagccatagtaggccgccattcccgggcctttatcgtcggaaacgccgcgggcatacatcttgccatccttgatggttggttcgaaggggtccgtatcccagccgttaccagcaggcatttcatccacatgggctaaaattgccaaggtttcatccccctcaccaatttcagcataaccgaccaagttatcaatgttcttggtcttaaagccatcgcgttccgcaatcgctaaaaacgtggttaacgcttgcttaggaccagggcctaagggtgcatcatccgtcgcctggctatcgtcacgaaagctcggtacgcggagcatggtggttaaatctgctaaataatcatcttgatgcttagttgcttcatttttccaatcaactgacatgttaaattcctcccacatattgttacctcaattttatcatagctgtcgtcaacttaataatcgtaagtaaccgcttttggaaaatggtatactcaaagtaaattaacttagaaagctggtcattttatgcaacctattacaactgaaattgttagccgaacgattatcaaacgaccggctgattctcacaaaggcaattacggccgaatcatgctgattgggggtaatcaaaattttggtggtgctatcatcatggccgcaacggccgcaacatatagtggtgccggtctggtgacggtcgctaccgacccgtctaatttcacgagtctacatgctcggctacccgaagccatggtcattgactatcatcaaacggacaccttattaaacctgctagcaggaatggacgttatcgtcatcggtccaggccttggaacagataccatcgctgatcagttactgaccgccgttctcgccgcgacgcacgtcccacaacgattggtcatcgatggttcggcgctaaccttgcttgcacagcaggcccgccccttacccgccacggacattgtggtcacgccacaccaaatggaatggcaacgacttagcggcatcgcgatcaaagatcaaaccccaactgccaatcatgacgcgcaacaacggttaggtgttatggccgtggtcaaagctcatcgcacgaccgtctacactgacgaacgagtctggttcaaccccggtggcacttcggccatggcgaccggcggcatgggtgacacgttggctggtatgattggtggcttcgtaagtcaatttcataatttcaccgatgccgttctcagcgcggtctacttgcacagtgccattgccgatgacctcgctgcaacgcggtatgtcgtcttgccgcatcaaatcagtacccgcattccgacttacatgcaccgctttagtcagattgaacgcccttagctagctggaccataatgaacacgaacaagccaacgacattatgctaaaaaagcctcaactaaccatgcttgaattcatagttagttggggcttaatgatttagtttaaaccagagtggccgaattcgtaacacgcactattcgcctacgggttggttcgcatccgccttcaacgctgttagttcgtcatcagtcagcgcacgatagttccccgctaataagccaacgggtagcgttaacgaaccaaacttgattcgccgtaacccgacgacccgttcacctaacgttccgaccatccgcttaacttggtgatacttgccttcatggatcatgattcgaatcgtggtaaagttctcgatttcatggaattgaacaatctcagcctgagccggttgcaattcagtcccgtcctttaacgtgatcccatcattaaaattagccaattgagctgcagtgatttcccccgttacttcagcctcatagaccttcgtaacatggtggttcggcgacaataggtcgtgcgatagggccccatcgttcgtaatgaccaagattccctcagtatctttatcgagacgacccacgggaaatagatcgtcacgaaaatccgtcgtattgaacaggtccatcaccgttttcgcagcggaatccgtcgttgccgtgatgaccccgactggcttatccatcacataatagaagtattgttggtaacggacctgcacgtcatctaaaaagacggtatcactgccagggttaatctgttgtttgccagagattactggctcaccattggcagtgatatgaccatctttaatcagacgacgtacttgagtccgcgtgccaattcgcatcgcatgtaaaaatttatctactcgcataattcacctatttaatccgtaatttccgtcgtaacccagcagctttcgttccaatcatcaaatcagccatccgtgaacggagtgctaagtaaacgtaaaccgcaccaccagcgataactgctagggccacgatcaagaacgattgcgtcttactgtgctcattcaacacaaagttcagcccataaacaactaatcgtgccgtgacgtacgttaaaatcgaataaactaaaattcgattgatttttggtaataacttcacgtaccgaattccaaagttgacttccaaatcatacatcgccatcagactcgcaaccatcatcccaatcgcggtcgcaaccaggggccccgccgttgataggaaatagatacatggtaactgaatcacgattttgaccagtaagccgatcaagtaatagcgaataatatcgcggttgcgtgataggccttgcatcagcgccgaaatcaccgtaaaaaagcctaaagcaatcgcggtaaatgctgagatctgcagaatcaaggtcccaatttgatcataactataaaagagcgtgttaagtggttgtgccactgcggccatccccagcgctccgggaatcatgataaataggaataaaataatcgaatcttccaattgtttacgaatattacgcatattatgactggccaatgattcagataaaatcggcacgaccgtcacggcaatcgcagacgccaatgacacaatgatcatcaccaatttgttcgcattaaatgcaaagtaagcatacaacgtatcgatctgcttagtacccaaatggtaaaccagccgcatcatcggttggaacgttgcttgatccaacaggttgaagactgtcgtcgcggtatcgatcacaataaatggaatcgcctgaataataatatcgcggaacaattgccagactggaataactagtttgttctcactctgagcagctaaggcatttagctcgggccgtttgcggaaataataccaaccgagtaataagaagctggcagccgccccgacgaatgctgcgaatgtcgattgggtcacggcattcacccaatcgccgtgagcgacgcgcatgatgaaatacgtcgcacccaacatatagatgacccgaaaaacttgttccacgaactgtgagattgcggacggcgccatctgttgatacccttggaagaatccccgggtcaaagacatcgatggcagaatcaccaaggcaatagccaacgcatgcaagacgggaatcagattggcatcatagcccccaaaagctgttgaaatcaagccagcaccaaaccataaaataatggcaccaataatcccaaaggctgacgtcaacaacaagccccgcttgaataagcgctgtccaacggcatattcattcatcgcattatattcggaaagttgtttagaaattgcggacggaattcccccgatcgcaattagcaggaaaaaactataaatattatatcccttggcataaagcgcgttaccttgcgtataatcagcgcccatccagataacccacgggataatataaatcgccccgagcacccgtgaaaagagactcccagccgtcatccaagccgacccgcgcaccatcttctggtgcgcttcggcttcagaattcacgtgtgcattctggggctgattagcttttgattcctcagacatgttcgtaacccactttcttaattcaatcctaatcattttagatgaaaaacaaacaagttgcaattcaattccggccttatgcgtgagtttaaccgaactttaatgataaggtcttgacaactgcaccagctattggcgaaccgtaccgccgtccgataccctatggctgatacagaaaaaaggccaatccgtacgctttaccagcggccacgatgcggtctcaaattcgattacagcagagtgccgccatgatatccatttccgctgattaaaccacgttactgctagttttaagttaagcataggtggttgcacacactctgcccaccaaaaacacgtgtgatttgtctcccaaaccgaaccagaacgtcctcagaatctttattcacttaaccaaatcaatcgtaaccgcactaattagttctgtgagtagttaaaaaatcgtgatagcaaccaacaattgtcagtcaccatcacgattaatttaagcgatattcatttaagttgatactggtcgtggtacttagttggcaaccacgttaaccagtttaccaggaatggcaatcactttacgaactgtcttgccggccgtaaattcctggattttttcatccgccagggctagtttttcaagttcatccttgcccatatccttagcgacttcggcgtgcgagcgaaccttaccattaacttgaagcacgatttggaccgtgtcttctactaacttagattcgtcatacgttggccaagtggcgtaggtgatcgtgtcatcatggcctaataatgaccatagttcttccgacaaatgtggtgcaatcggtgacagtaacttcacaaagccttcgatataaatgattggtaaatcgtcgaccttgtatgcttcgtttacgaagaccatcatttgtgaaatcgcaatgttaaagcgcatagcttcatagtcttccgtgactttcttaacggtttcgttgtagattttcgtcaacttaccatcattgatagtcgtgattcgatcgcgaacacgattgttttcatcgatcattaagcgccaaacccgttcgatccacttattggcaccatgtaacccatcggtactccacggaatcgaagcttccaatggtcccatgaacatttcgtataaccgcaacgtatcggcaccatattggtcaacaatatcatcggggttaaccacgttcccccgcgacttagacatcttttcgtgattatcacccaaaatcatcccttggttaactaacttctggaatggctccttggttggcacaacgcctaagtcatataagaacttgtgccagaaacgtgcgtaaagcagatgtaagaccgcgtgttctgcaccgcccacgtataagtcaacgggtgaccagtacttcaacttgtcataatcggccaaagcttcacggttgtgcggatcaacgtaacgcaagaagtaccatgaactcccggcccattgtggcatcgtgttggtttcacgcttccccttacgaccgttttcatcgacgacatttacccagtcgtcgatattcgctaacgggctttcaccagttcctgatggttccaggttcttagttgctggtaaccgcaatggtagttcatcttcaggaaccaacgtcgtttcgccgtcttcccagtgaataactggaatcggttcgccccagtaccgttgccgtgagaagatccaatcacgtaaccgatagttgaccttcttttcaccggcatggtgttcacctaaccagtcaatcatcttatcaatagctggttgcttagctaaaccgtcaacaaaacctgagttgatgtgttccccgtcgccagtgtaagcttgttggtcataatcattatcacccgcaatgacaggtttgattggcaaatcaaatttttgtgcaaattcaaagtcccgatcatcatgagcaggcactgccatgatggccccagttccatatgaagccagaacataatcggcaatccagattggcagtttttcaccattaaccgggttgatgccgtagctaccagtgaagaccccggtcttgtccttattcaaatcagtccgttcaaggtctgacttgctggcgattttagctttgtatgctttgatagcgtccgcttgttcgggtgtcgtcaattgttcaactaagtcgtgttcaggtgccaagaccatgtaacttgcgccaaacagcgtgtctggccgcgttgagaacacttcaatctcggtatcgtcaggttgaccagcaaccttgaaacgaatggatgcgccaactgagcggccaatccagttacgttgttgctctttgatgttttctggccaatcaatatcgtccaggtcatcaatcaaccggtccgcataggccgtgattttgaggctccattgcttcattggcacccggtaaacatcatagccaccgcgttccgtcttaccatcaaccacttcttcattagaaacaaccgttccacccatcatatcaggagcccagttgaccaacgtttcagattcgtaagccaagcccttcttatagagctgttcaaagatccactgcgtccacttgtagtaacttggatcagtcgtattcacttcacggtcccagtcatatgaaaaacctaatgaccgaatctgacgtttgaagtttttgatgttcttggccgtaaagtccttcgggttatgccccgtcttgagcgcatattgttcagcgggtaaaccgaatgcgtcccaacccattggatgtaagacattgtacccttgcatccgcttgaaccgtgacataatatccgtggccgtatacccttcaggatgtccaacgtgtaatccttgaccagatgggtatgggaacatgtctaaggcgtaatacttcttcttatccgtcgtatctaatgttttgaaggttttgttttccttccaataatgttgccatttgcgttcaatgactttatggttgtatgccatagtagtgcccctttcttgctgccttgtatgtaaaagctagcattgcgactttccaactgactattcaagatggcattttcatgcttcaactcagtaaaagcggttaaaaaacaaaaaaatcctataagccaattaagcttataggacgaaaacgggttccgcggtaccacctatgattccacgttaccgtggcctcttgggaatcttaacgcgaaaccacgtccgtacctacaatcttgttcagccggaagactcgaaggtgagttcatgattggtgaatccccgtttgcaactaccacggagtttctgcaaaacaccagccactactattccttctcagagtcgtaaagttattgttttcatagtagcaaaccagcacgtttttttcaagggcccaagccccgctggcgataaattttatcatcggcattaatcggacccctgataaaaatgctataataatggcaataatttatttatcggaggaatcagtattgaagcaacgatcctggcaacgttcggacagtttgattctacttatatttataggatggttaggctggacggccgcggtatggcaacgggcgccttggttaacacactttgacaccacggttgctaatttttggcatcatagtccccagtggtttcaacacgcgatggtcacgtatacgcagcttggcaatccccacaccatcaccataatcacgttaattatcggcctggcactctggctgggccataacccacgcggcgcagtcttcttttgggtcaccacctggctgattgccggctacggtaattatctcatcaaacaggtcatcatgcggccacggccaaccgcttggcgacttgtccaaattggggggtatagttaccccagcgggcactcaacaacaacgaccgtccttatcggtagtctgctcgtgttggcatttgactactggcaccgcaatgccttgactggctggctcactgccctcggcataacgtccatcttgttaatgatgatcagccgggtcatcgtgggcgtccactatcccagcgatacaatcggtggccttttacttggaagtgttttactatatataagtgcgcgttttagtatgcgttatcggcacggaccgcttcgattgcggccctaattcatgaattcaacaagggggtaacactcattcaactcagttcggcattagcttatagccacgcgctaatgaaccaagtcgtcaatcccggtgaccacgtgattgacgcgacggttggcaacggccatgataccgtctacctcgccaatctggtcgggactactggtcacgtcgacgggttcgacattcaatcagcggccattgaagcgacgacaactgccttagataaagcagcgctcacccatcaagtcactctgtggcaaacgggccatgaacacatcgcagataagattgccgctgatcaacctatcaagtgtgccgtctttaacctgggctatttaccaggtggcaataaacaaattattacgaaaccaacgacaacgttaacggccataaaagccattcaggaacgcctcgtcaccaacggactcattatcctgctagtctatgctggtcatcccggtggtgcgacagaagcacaagccgttttggattacgtaacgaatttagaccagcatcaattccaagtcctacaatatcagtttattaatcaagtccatgtgccgccatatttgttggccattcagaaacgttaatttaacgataaattagccgaaaagacctgtcagacgattagcttcgtctgacaggtcttttcaattagatacttaacttaaaaaccaatggtaccttacttctcccacggatacttaccgttctcatccttaggggtattacgcatgatccgcttagttccctcgtccatctcgttacgccgcttcttacgattatggtgacgaacaattaggacaagaccaccgatgccacagtacacgatcattcgggtaaacatcttaacggtcccataaatggtcataatcattaacattttgcgccctcccttgccgtcaaatctacttaagccgtgaccttagcaggcttaaagtaatctaacaatgcttgccactgcttgaaaacggcttcttctgaataacgcttggcattttcataggcctgagcactgtattgtgccagctgcccttgattcttcaacaattctaaaatcgttttggtcaattgttgcacatcgccgtctgtcgttaggattccactcttatgatcctgaataatatcactcgggccgtacttcacgtcattggcaaccattggtaacccatgggcttgagcttctaacaacatcaatgagaatccttcagctcgacttggcaaaagtcctaattgggcccggttgtaaacggcattgacatccgtggtataccccttgaacaataccacatcttccaagtgcgctgcagcaacttgtgcatgtagttgcttttcaatatccccgttcgcataaccccataattccaacttggcatcaggaaactgcttgtgaacttcaacaaaggcttcgattgaatgattctgttgcttttcaggtgccagccgcgcaacttgcacgacgaggtctttttgtcgttggtcaaacttcaccggcgcggcttttaacgtagcattatcaacatagccaaccggaatagtgaacgctggaatatccttaccaaagcgggcttccacgtccttagtttgttccggtgtcgcagaaatgaccgcgtcccaagccgcccaattattcagcgcattagcataattattgttcaaggtagaatgcataatatccttagcatcactcacatggttattatgtagatgcaagactttcttagctggtgtggtcatattgaataagccccaggcacattcgacggtccgatcacaaatgaagacattttgttcatcattcaactggttaagttcatcatagaagtaacgggtcagttcattcatcccattaaaagtatggctctgctcgttgtagttcaagacgcgccacgtgattcgctcctgaccagcgtgatttaacaagtgtaacttttccacgtgaatcaatccatccgggccaaagtacgcttcttgggcaatcttaccgtcccagtcaaataattgttcaagacacttaaagccccgcgtatcccaccaactcatcttgagcgtacgaccattaacgtcaaagtattgcacattgctaacggcttccgtaccggcccgaaggtaaataatcatgattaacttaccacgttccatgacttgaatctgattatcctttcgggtcttgatagcatcggctggcacttcaaagtcggccaaatcaaacctttgacgcttgaccgactgactaccacaaaagaagtcaaaaagattaacaaaatcagcatcggcaatgttggccccttcaagcacatcgtgcaaattcattgcgaatacgcgggtcacgattttagcggccacatggtgcttcttgaataaagtcagtcggttgatttccgcctgttcgattcctgattttgaaaattgcatgttatcgtttaagaaataatacatatgcgccctcctacttaatacccagtaattgttgccaacggtgccaaacttttaagtcagtttgtgacgtatgaagcttcttaaaggcggcttcgctgaatgccgtcaacttcttcgtatccgtcattaattcgatgacccggtcacgcagcgccaattgattgccaggatcaacgatgaaaccgtcatgaccgtcatcaatccaatctttaggcccataattaaagcgataactaatcactggaattccgtgactcatggcttccggcatactcattggaccaccatcaacaatatcggtattgagcaacagctgataatcatcataacgtgtttctaaatcaggatgataatctaataaatgcacattattcgtcaattttaattcttcaaccagcttattcagcgtcttaagatactctggatcgccgtagccgtaaaagtcacactgaatttctttgacctgttgcttaactaacgcaatggtccgaattaactgattcagttgccgatccggcgccagccgcccaacgtatagcaattgcttggggcgggccgtgattggctgtagtttactctgcgccaacggactcgtagttacagttggtaacactgtcaccttagctttagggaaccgcgtccgcagatgctgagcctgactttcagtagctgtaatgaaaccatcaaagtgttgcagattatcgaaggccggtgttaagaacccgtccaacggggaatgaattgggtcattaatatccttcgcctgataaattggaaccgtcacatacttgtgagaatcatcctgaagttccaacaacggcttcacactggtacctgggcgatcactaataaaggtcgtcgtttgcttgtccaaatgactgagttcggccaagaagaaacgaaataaatggttcgcgtcctggaagaagcgctctgcttgatcacgataattctttaaaatcaaacgtgacgctagcggattaccgttagtgtcaggtacatagtactgctcaataacggtctcgccttgtagattataaaaccgttccaaaaccagtttaccgttctgaccaaaatattgtgtactggacttgaagcctcgccaatcccacaggtcagttgaagataagttaccttgattgtcgaagaattcttggtaaaagacgcgcccaatcgttccaggaataaagccgacgttgctaacgtgttcatcaccattaaaaattttgctaaagttggcacccacttctaccgcatattcaactggcagatgcatgtcatcagtatgcagaactttagttggcacatccgtggtttgttgaaagtaatcaaacatattcagcacttgctggtttgctaactgaaaagttcccatggtctgatgtagcaaacggtcatacatcttagtcacaatctgggctggcgctttatagtggttaaataatttcacccggttgattgccgcgtgctcaacactcgaattcttgcctaaaatatattcattaatgaagtaaaacatacagtcaccctttctgttacctagtattatgcttgtcgatatgtgtagttataatagttgatcaacccagataagaagtgttcacaatcgtcaatccgtgtccggaaattgtcatgacgtacatagaacccaccaatgaacttctgtggattatagagatacattgcaatctcaggtagaaaacacccagtagtaatctcatacaacgcacgataccgcaatacctgccgtaaacgaaccaagtcataaggtgctatcaagtcttcattacctgaacgtttaatcatatcggtcattttgacggccgcatcaactaactcaagtaatgttggatacgtggtatcacgctcttcaatgaattttagatgactgaatacatttttcaaacccagtttcatataatcatgattgtctgggaataccagtaatgcttcattgattgcataagaaatccagtgatcatggtatttaccatagtcattagccaccatgtaatccaagatttgcttcaccagatccatcacattcttatcatgtgttaactcatatagtcgggaaagcgcaaatgcgacttctccttcataatagataattcgataagctgctttgaccgttaaatctggatttaggacatgaattaacttaccagacggttcttggaagaaatggacgcctttaaaagctttcattaaaactggcacgaaagtatcatccttggtaacgtcttgatatttactcaatgcaagtattaacaaggcctgtccacccaactttagctcgccattatcatcgacgaagattgcgccctctttttcaatcgtggcgttttttaagccccactgaatcgctaacttaacttttgcaaaatcttcagtacgctttgtgaatggaatggcttccagcaaggcatataaggacgaaaaatgccgcacaacattgtaattgctaagaactctttgacgagccggaaaataaccgtagacaaattttccattgccttttaactgattaattaggaaagtttcaccatcttcaatagctgattgcagctcgctctgctcgtcagtcaccacccgaacgcccttaccacaatcctcttgctcagatagattccagattttctgcccgtcagtaaatacaccagcggttgtaaagacccaaacattttctgtctttcgaatatcgactggtagcgctccttcacgcttgttaagatacggctctactcgatcatagtcgacccaagaacccgaacgattcttaccaattcgatgcgctttgctaggacggaaaaatgcttgtccattactttccatctccaataaggctgtcttgaaatctgcatcaaaactaataccgtatcgccaatagttcatccgaaaagtagctgccaatcgcttttcaaaagtttctcttggtaacttctgtgttgattgaactgcttctaatcgaacccaactcgcttgaggggttttggctaattgttgtgcaactgctatccaagcttgcttgaaagaatcgcaacgatagaatcgcacttgggcccgatgtcgatgatccgataccgaaagtgccaaggttacggtacttgtaccgtaatctttcaaatttccagttgcaatcagtgcttgcttaagcttggtgacagtagatttttgcatcttagtcttacctctttcaattttcttttatgtacgccaaaacgggcttcacgcccgttttggttaatagtcttattttacaacgtatatcgttagcagtactaacaaatcagctttaaattttaactatttttgattctcgtcatcttcatcatcatctttacgacgacgaccgaacaagaagaaccaccagccgagtccagcagctgcagccgcggtcaacaagccaccgaaaatcgttccggcattattacttgtatcagatgcagtcttaccattctcgtcagtattacttgagccaaccttatcatcagcactatcagtatcagctgacttcttatccttatcagaatcattactactcttcgaatctgaatcagtctgatcagaagttgcatcaacgtcttgagcgctagcagcggcataaaccactgatgtagcagcagttgctgacgttgttgcagcaccgtcactggatggtgtcgtaaccgccaacgttgcggctgtggccgagacaccacttgttgctgcagcactcaagctagtcgtacttgtcgaagcagcaccgttgttagaagcagtcgatgaagttgtcgtaccagtgccagtacctgaattatttccagtagagcccgtcgtattgcccgaacctgatccagtatttgaactggaacttccatctgagccagaattactaccattgtcagaattggttccatcatttgaatctgaatctgtgattgtatcggagtcactgtcgttattcgaatcactgtctgagtctgagtcgttgtcggaacctgagtcgctgtctgagtcagcgtcactgtcggaatccgagtcgctgtccgaatccgaatcactgtcggaatccgaatcactatccgagtcggaatcgctgtctgagtcggaatcactatctgagtccgagtcactgtcggaatctgaatcactatctgagtccgagtcactgtcgctatccgaatcgctgtccgagtctgagtcactatcggaatccgaatcactatccgagtccgaatcactatccgaatccgagtcgctgtcggaatccgaatcgctatccgaatccgaatcactgtcggaatctgagtcgctgtcggaatccgaatcactatccgagtccgaatcgctgtccgagtccgaatcgctgtccgagtccgaatcactgtcggaatccgaatcgctgtcggaatccgaatcgctgtccgaatcggaatcgctgtccgaatcggaatcactatccgagtccgaatcggagtcactatcggaatcgctgtctgagtcggaatcactatccgaatccgagtcactgtcgctatccgaatcactgtcagagtcagaatcgctgtccgagtccgaatcggagtcactatcggaatccgagtcactgtcgctatccgaatcactgtcagagtctgagtcgctgtccgagtcggaatcgctatcggaatccgagtcgctgtcggaatcggaatcactgtctgagtctgaatcactatcggaatccgaatcgctgtcgctatctgagtcactgtcggagtctgagtcgctgtcgctatccgaatcactgtcagaatcggaatcgctatcagagtcggaatcgctgtcggaatcggagtcactatctgagtctgagtcgctgtctgagtcagaatcggaatcactatcagagtctgagtcactgtcgctatccgaatcactgtccgaatcggaatcactgtctgagtctgaatcgctgtcggaatcgctgtcgctatcagagtcggaatcgctgtcgctatcggaatcactatccgagtcagaatcactgtcgctgtccgaatcactatcggaatccgagtcactatccgagtcggaatcactgtctgaatccgaatcactatccgagtcggagtcactgtcggaatccgaatcactatccgagtccgaatcggagtcactatcggaatcggaatcgctgtcggaatctgagtcactgtcgctatccgaatcactgtctgagtcggagtcgctgtccgagtcggaatctgaatcactatccgaatccgaatcgctgtcggaatccgaatcactgtctgagtcggaatcactatccgagtcggagtcactgtcggattcggaatcgctatccgaatccgaatcactgtcggaatctgagtcgctgtcggaatcagaatcactatccgagtccgaatcgctgtcggagtctgagtcgctgtcgctatctgaatcactgtcagagtcagaatcactatcagagtctgagtcgctgtcagaatcggaatcgctgtcgctatctgagtcactgtccgagtctgagtcgctgtcgctatccgaatcactgtcagaatcggaatcgctatcagagtcggaatcactgtcagaatcggaatcactgtcgctatccgaatcactgtcagaatcggaatcactatcagagtctgagtcactgtcactgtccgaatcggaatcactgtcggagtcggaatcgctgtcggaatcggagtcgctatcagagtcggaatcactatcagagtctgagtcactgtcggaatctgaatcactatcagagtcagaatcactatcggaatctgagtcactgtcggagtcggaatcactgtctgagtctgaatcgctgtcggaatccgaatcactatcggaatcggagtcgctatcggagtcggaatcactgtctgagtctgagtcactatcggaatcggaatcgctatcagagtctgaatcgctgtcgctatctgaatcactatcagagtccgaatcactgtcggaatccgaatcactatccgagtcggagtcactatcagagtccgaatcactgtcgctgtccgaatcattatcggaatcggagtcactatcagagtcggaatcactgtcggaatctgaatcactgtcagagtctgagtcgctgtccgagtcggaatcgctatcggagtctgagtcactgtcgctatccgaatcactgtctgagtccgaatcactgtcggaatcggagtcactgtcgctatccgaatcactgtctgagtcagaatcactatcggaatccgaatcactgtcggaatctgaatcactatccgaatccgaatcgctgtcggaatctgaatcactgtcggaatccgagtcgctatcagagtcagaatcactatcggaatctgagtcactgtcggaatcgctgtcgctatctgaatcactatccgaatcggaatcactgtcggaatcgctgtcagaatcactatccgagtcggagtcactgtcgctgtcggagtccgaatcactgtctgaatcggaatcactatcggagtcggagtcactgtcgctatccgaatcactgtctgaatcggagtcgctgtcggaatccgaatcactgtctgaatctgagtcgctatcggagtccgaatcactatcagagtctgagtcactgtctgaatccgaatcactatccgaatccgagtcactgtcggagtccgaatcactatccgaatccgagtcgctgtccgagtccgaatcactgtctgagtcggagtcactgtcgctgtccgaatcactatcggaatctgagtcggaatcgctgtcggagtctgaatcactatccgaatctgagtcactgtcgctgtccgaatcactatcggaatctgagtcactatccgagtcggaatcactgtccgagtcggaatcgctatcggaatccgaatcgctgtcggagtctgaatcactgtcagaatcggagtcactatccgagtcggaatcactatcggaatccgaatcgctgtcggagtccgaatcactgtctgaatcggaatcactgtctgaatcggaatcactatcggagtcggagtcactgtcgctatccgaatcactgtcggagtccgaatcactgtctgaatcggagtcgctgtccgagtccgaatcgctgtcggagtccgaatcactgtcggaatctgagtcgctatcggagtcggaatcactgtcggaatctgagtcgctatcagagtcagaatcggagtcgctatccgaatcggaatcactgtccgagtcagaatcaccatccgagtcagaatcactatccgagtcagaatcactgtcagaatcggagtcgctatccgaatcggaatcactgtccgagtcggagtcactgtcgctatctgaatcactgtcggagtcactgtcggagtcggaatcactgtccgaatctgagtcactgtcgctgtccgaatcactatcggaatctgagtcactatccgagtcggaatcgctgtcggagtcggaatcactgtcgctatctgaatcactgtcagagtcggaatcactgtcgctatctgaatcgctgtccgagtccgagtcactgtcagaatcggagtcgctgtccgagtccgagtcgctatcggaatccgaatcactgtcagagtcggaatcactgtcggaatcggagtcgctgtcgctatccgaatcactatcagaatccgagtcactgtcggaatccgaatcactatcagaatccgaatcactatcagaatccgagtcgctgtctgagtcagaatcactgtcggaatccgaatcactgtcagagtcggaatcactgtcgctatccgaatcactgtcgccgtcagaatcactatccgagtcatcttcactaacattagcagctaaatcagcatagtaacctgcatcatcagcggcacttgaagctttctttttagcttcagatgcttcggacgctttctttttagcttcctctgcataactggaagcagccgagttttcgccagcagcttccgcagaatctgcatttgattgggcggctgccgcattagaggctgcagttgaagcagctgttgcggctgactgtgcatcagaagctgctgccgttgcttgttctgcgtaggagcttgcttctgagtttttacttgcatattcgcccgcaatgttcgcataagaactagcaactgaaccatattccgtcgcttgatttgcgtagttagctgcttcgctagctgcagaatctgccgcttcagttgaaacagcattaacagtcaagtaagcccggcctaaagttacagttgtcgtggtagtagtcccgttagtcgtattggatccagtaataactaggtagtaataaccggattgccctactgtcagatccgacagattaagtgtcgtaccagtctgaccactcagcgctgttccagtaccgtccgctgttgaagaataataccattgataagtaacattagtcccagtacccgtagtcgagccatctggaacccacgtcaaatcacttcctgcatcaacagttgcatcctcaaggccactaccaattgtaattgtctttgaagatgaatagctagttccgtctgcatttgtaattgttgctgtgattgtcaccgttccattagacacaacggtcaaaaggccagaatcatcaattgtcgcaatgcttgaatcacttgtcgtccaggtaatcgttcccgtagcattctcagggttagtcgttgatgtaaactggctagtaaccttatcgtttgagccactcgaactgttcgttggattaatgacgtaatcatcaccagctatggaaatgtttgttgctggaatattgctactataaacatctacttccgctaaattacttgcaaatgtataaactgtagccaagtttaataagtcccaagaaaacccttgtacggcttggaatagtaatgatccagtatagcccgctttgatagtaactgttaatgagctactggttgacagtaaaccagcactgtcaactgcatcatatgattcaatataagcgctggccttatctaaggtcatccaagtgccgttgacttgaacataccaagttgtttttgatgatagtgcaaccccacctagtcctaatgctgacgaagctgacaaggtaaaggtcccaccagaaacggtcgacgtcactgctgcgggttgagaagtcatcccaccagaaataacaatccctagaattgtcgttgcattacccgtattagtgcttttatatgaattcgtattgtttgaataattcgtcgcgttgctagccgccgtactacctaaagccgcattggatgtagacaatgccgcatatgaggttgcttcactagctgctgctgaggcattggtcacatatgagctggccatagcataatcgcccgcagctactgccgatgaagcctggcttgtatactgagctgccatttccgcagctgaagttgcggccgccgctgcacccaaagttgtcacggcataattattagtttgtgcaacgtatgagctacccaacgtggtgtttgacgcatactttgcacttaatgaactcgcgacactgattgcgttcccggctgccgattcagctgctgacgctgcgctagaagcagccgttgcaatcgaattataataactggattgtgcttgcacgaccgtttgggtaatcgcactcgccgcactcgaagcagcattcaattgatctgtggcataggttaaacgcaaagccgcgtagctttgttgcaaggcagccgaattataattcccgtccgctgcatatgaagcagcaagacttgctgcttcactagctgccgcagcgtatgaactagccgctacagctgcagaacttgccgctgcattataactgctagttgcagtggtattaaatgaagaaccagcaacgttatatgcattagcagcgttggccgcataggatgcagctaacgaggcttggtcaccggccacatttgccgatgacgcagccatactggcataacttgatgctaaataatcagcagcggtatcaccaccatcttcattaaccgcatttttcaaagcagtatcgagactagctgctgcctcagatgccgcactacttgcagaactagcatattcagttgcaacactcgcataactcgatgccattcctgcccagatattagcactggtatacgccccttcggcttcataagaagcggccgaagtactggccatagttgcaatacttgccgcctccgaagccacactcgcatatgagctagctgcgttgtatgaagaattagcctgtgatgtgtagtagctagctaatgagcccgtcaagttagctgaagaactggccaaactgatcgcactacttgcagcggcagcttgagaggttgccactgaggctgcgctgttggcttggctggcataactgctggcaatttcagtgtaggtcccttctggattggtaacaacaatggtaatcacattaccagctgcttcaaaatttgaagtcaagattaatgctgtaacccgcttaccactaacgactgcttgataataatacgtccctgaagtagttgcagttgttgtatacgttgccgatgttgcaccactaatggtcgtccaagttgctccatccgttgagacataccaaacataagttggtgtaccacttactgaatatcctgaatccaaacccaccttgttggtaattgtcacagtatctccagtcgagacactttgcgttgccgtactcgtcgttaaagtcgcattggaactaacggtttgttcattggcgacattcgtcgaaaacttagcagctaaagtcgcgttagactcagcagttgcagcgtaactagcagccaatgaagatgccgattgggccacccgagcgtatgagtccgcggtggcaggatcactagcactgacagcagattttgcagccgtgctggcgacggcgtaggctgacgaagcagagctagcggccgttgcagcacttgaagcataagctgacgcttgagtaccagtttgcgttgccgccacactggccgcacttgaagccgtactctttgacgtattcgccacgtttgcacttgaagaagccgcactcgccaaatcactaattgcagtactattggcaaaaatggctgccgaactagcggtgctagtagctgtgctcccggcggcgtattgactaagcgcctccgttgcggcggaggaagtaactgcataggcagtactagtggcttcatagtcattatttgccgcattactacttacagcggcatatgctgaagatgctgccatcgcagcggtcgttgcgttaaccgcggccgttgaagccgcagctgccgtgctagaagcgacggcgtaagctgaggtaacggccgtattatttttgtcgtattgcatggctaagtatgcactgttggctgcttcagctgccgagctggctgctaccgtggctgcagatgccgcactagatgcggcggaataattgctacttgctaaattaattaagccttgggtagcagcactgctggccgttgaggtggccgttgaagccagggctgcgtatgaactggccgcactggctgcactaaatgctaaagagttggcattagcgtatgccaatgtattatctacattggaccccacaccatttgtcattgcgtctaagtacatgtttgcaatactattgtagtgccgtgacaaatcagccgcgttaagcgcttcttgataggcactttgggccgcactcactgctgcttgcgtcgttaggttattgaccaaactagcataactgctggcaagtgtggcgtatgaaccggctaatgaagctgacgatgaagccgccttagctgcggtactatcggtatttgagctggcagccgattccgacgagtaagctgcaatggctgccgttgaagccgccgtacttgcagacttagtcgtgctggcaacactgcttgctgtcgagacagtacttgccgctacgctagcactgcttgacaaactcgtcgtacttgagctagctgcggaagaactgctgctatcagttaaactcgatgaagtagcgcttgacgagctcgaactactacttgaacttgcgctggatgcgctcgaactagccgttgaaacactgctactactagtacttgatgtacttgtcgcattagtcgtacttgtttcgctcgcagaacttgcgtctgaagcactgtcatcgctgcttgaactatccgatgaagattcggaattactgttcaaggcagtttcgctcgaagaagatgccgtagacgagtcactggtagtactagttgacgtactacttgccgttgcagcagctagtgccgccgcactcgctgctgcagaagacgtatccgcccccgagctggcactactagtggcactacttgccgtatcgctactagtatccgccgaaaccgtatctgcatgagatactaactgaggtgcagcagtcaatacaaatgatgccatcgccgtaaatacccaagtacggccgactttaaacatcttgtagtgaacttgcggatctcccctaaaagatttatgtctcagaaatttcatggttttgccttccttctctaacctaatcaaacccgtttatatatgatacaaaaaacacatatatagcatcattggtatacaccatcaatcgttaggctatgcactcataatactatgattatgttttgttagcaatagttgataccgtcaatcttgttacacgttttccattaattttcctaaaatagttaccaaataaataatattaatgaaaacgagtgtaataggcctcataaagcccattacactcgtctaacaacttaaaatttatttataacacttatggaaattttattgaaaatttttcggatttttttacgtcaatatcaaataaacgacaaattatgagtcactttgacaattaatttgttgatactaagccgactaatcctgattttggtttaaatcagccgcgtgttgtgctgccgttttttgtggtccgcgatccaaactattcacaataaaggctagaataaccaaaccaaggccaatcaggtagacccaatgtaagcccgtatataagatacgatgaagtgtcggcaacaaatgagacggtaattgcgttgctgtctgtggattgatcaacttgttcatcatcgccatgttcgttcctgcatggtgctgaataccttggttcatcccaacgttcaacgcaattccaaagattgaaatcatcaacgtttggccaatcgttcgactcaacgtattgaaggacgttgcgacgcccacgttctcagctggcacaaggtgttgcgacgtgacggtcgttgctgtaattgtaattccgaagcccacgccaccaatcgctgtgatcaggaagaaccatgggaaagcagtattaactggcaaccacgctaagcaaatgcttgtcacgaggatgaaagccaaactcagatacaaaatccgtcgcggcgcccactttgccaataaccgccccgtcacgaatgacccgacgatccacattaacgagctcggtgtcactgcgaatcccgccaaagaagccggtacacccagtatcccctgagtccaagttggaatataaacttcaacggccattaagaaaccactgactaaggccgccacggcattctgaataataaacgtgtggtttttgaataaatccatcgaaatcactggttcatccgtgcgactttcacgacgaataaatagccacaaactgagcgcactaatgatccaagcagtcccaacggccacccaactgatagtggcgtttcccaatagttggaagcttagcatcaagcacagcaagaagagcatcagccaaaagctacccaagtagtcgattttcacgttattgtgacgtttgggttctcgtaaataaaattgaaataggaaaagggtgatcaacccaactggcacattaatgaagaaaatccaatgccagctgagcttatcgacaattagtccaccaatcaacggtgccagcactgaagcaatgccccacgctgaactattgaagcctagcactttggcccggcgttcgaatgaataaatatctgcgataattgtcattgagactggcattagcgccccggcaccgatcccctgaatggcccgccaaaaaattagcaccggcatcgaattagacaaaccgctcatcatagacccgataataaaaataattagtccggcttgcatcactggttttcggccgaccaagtcagtcagctttccataaattggcgtcatcatcgcattagtcaataaataaattgagaaaacccaattcatcaatgaaaccccgtgtaaatcaccaacaatcgttggcaaggcggtcgacacaattgtcccttcaatcgcactcataaacgtcgcgacgtaaatggcaaccgtaaccgccattacgttagttttacgctgttgcatcttagtaattctccttctctatcaatcattttaaaaccccgtgcatctaaaatagcccgcaaaaaaaagcgaccttgaaaaaaggtcgcttttagcgtcgagtacctacagaccgtaacgaatcaacgttaccgcattatttaaatgctgcttttaaagcatccactttatcagtatgttcccatggcaaatcaatatcggtccgaccaaagtggccgtatgccgcagtttgccgataaattggccgttgcaaatcgagcattttgataatcccagctgggcgtaaatcaaagttttcgcgaatggcgttaatcaacgcttcatcactaaccttcccggtcccggcagtatccactgcaatcgaaactggttcggcaaccccgatggcatatgccaattgcacttcgacctgatcagctaaaccggcagccacaacgtttttggcaatgtaacgagcagcgtaacttgcagaacgatcaaccttggtcgcgtccttaccagaaaaggcaccaccaccatgatgggcaaaaccaccgtacgtatccacgatgactttccgaccagtcaaaccggcatccccttgaggaccaccaataacaaaacgaccagttgggttcacaagatacttagtttggtcatctaataaatcagctggtaacacagccttgatgacttgatcaatgaccgtttgccgaattgtatccaaatcaacatcaggatcatgctgagtagacaagaccactgtgtcgattcgcttaggttggttgtcttcgtcatattcgaccgtgacttgggccttagcatctggacgtaaccacttaatggtaccatccttacgtagcgctgcaattttacgcatcaaccgatggctcaatgcgattggcagtggcattaattcaggggtttcgttgatggcataaccaaacatcatcccttgatcaccagcaccgatttgatctaatgggtcagcatcgccagaacgcgtctccaaggaatcatcgaccccttgcgcgatatctggtgattgttcatccaatgagacaaggacggcacagttgtcaccgtcaaagccgtattgaccgtcaacatagccaatcgacttgatcgtgtcacgcacgaccttttgaatatcaacgtaggccttggtcgaaacttcaccgaagaccagcactaatccagtcgtcactgaagtttcaacagcgacccgtgcttgtggatcctgggctaacattgcgtccaagatagcgtcactgatttggtcagcaatcttatcaggatgaccttcagagacagattcagatgtaaataagtgtctttcactcacaataaattcccccttgataatttcggttacaaggcatctaagcatcacttattcttcattgaacaagctaaacttatcctttcgggaacggctcataactatataaggttatcacaatcaccattttttttaaagatttctgtcaaattattgacgggaactgccccgaccggtacgattaactcattatcctaattagagagtgttgacaatatgattcgaatcggaaaattacatattaaacgcgattacatcgccttggcgatctttaccatcgttcaaagcatcattagttggtgggccgccctcgattacgggcgctcatttcaaacggcctcattttcagccgcgcagttaccactgattggctacaccttagccgtggccgccgcggtcttcattatcttagatcggcggattgctccccagtggagcctcattgcaattggaattaccgtggcctttgcatttaccaacattattgccaaggaatccgaactactgtacctgctattaacgtgcagtgcgtggttgctcgtgatggctgttccacgcttcggtatgcaaaactactttggtctagtcgttttcggcgtcatcatgacgttcacgatcccagtggccgtcttcgatttacaaaataactatttatcaactacttttctctggaagctgacccccatgctggctagttatgtcttcctatatgttccgagcttcagccgtcaacgccaaatcaatcaactgatttcggccatcaccggcctgctacttgttatcaccatcttcctgcagccgttgacctggcaaacgatcgttgcaattctcatcacgattgctgtctggttcagtcaacagtcctttggccgtactcggttacatctcatgatcaacgtagccgttcagttggcactgattttattactttattaatatctagataacaacaaggcgtctacctagtctctcaaactaggtagacgccttgtttgcccctatcaccagttcttaaagtgctgctattaactggcgccacttttcaataatcgtctgcttgctgtaacgagttgctgaattgtaggcattcgtaatcagttgtgcttgtcgttcagggtgctgtaaatactgacgaactttcattgtcaactcatcaacatcattgggtgtcactaagtacccgttaacgccatcttcgataatatcttccggcccgtacgcaattcgatagccaataaccggcacgccatagctttcagcttccattgtggctagcgaaaagccctcttccacactcgtcattaaggcgaggcttgcccgctggtactcttctgccagattgggcaagaaaccccgaataacgatatttttttctagatgattggcctgaataaattgacgcatttgcatttcaatcttttgcccatgcccaaacaactgcaaagtcaggtcgggaaattcaccaactaaccgacgaaccacttccagttgatgtggtaattgcttttctggcgaatagcgcgccacactaataatccggtgcgggtcacgaccatcaattttaaccggatgaaccgttgtatagccgactggaatcacgacaactggtggtaaattatcatagcgtgccaataaatcacgcttttgatgctcggtcgacacaataattcggtgaaattggtctggatgggctaggacataccgatagaccgatttcaaatgcccacttaccacgtcctcaccaatccgtagatgcgtgctatgtaagactgaacacacgcgagttgcggggcgcgtatgacctaaggccgccgccgtttgtcggttacgatcacagaaatagacgtcatcagcagtggccaattcattgaagaagaatgtctgaaaagcctgttcggtattgaagaaaaagtctctttgttgatagttcttcaacgtaatcagtcgtagttttggctctggcccggtaatatcatactgtttgataattttgacttgcccttgtaaatcataatacacttctgtgtgcacttcctgatgtttcactaaaaagcttgtccggctcaggaagccccggttatcataaaattcgcgtcggactttaacaccctgattatcaaaataatttacataatccaattgttgtcgcccggcgtccacaaaatgaacgtacatcaaatattgaccatcggtatccaggacgcgaaaatccgtcgtatttggaacctgaatcaccttaaagtgacaaacagcttgccaatagtgcatccaatcatgatggattttagtcactgcttcaggcatcgtcccctgaaagaaatcatacaaactaaagcattttccttccgcaccaaagcgggccgcatgctcatgtaaacgcggattataagtgacatagacgcatcgagcctgataaccagcggcgtcaaatagcgccagtcggttcaactgtgccttttcaattcccgtcaatttcaatcctaaaccagtacccacaaaataatacatcacctagccgttcccttctcaatctgaaaaatcaactcatcctgtcaccgagttcaaaaacttcgagtacgcacggacgattgaccacttcatctgttatatctatacactatctttaccctaccatatttacgttactcgaccaagatatgaacagttttattgacatacaaaaatcgctagtcgtgaacaactaccgtatcagcagtgcccgactagtgatttttcaccagtttcaattaaattgctagccatacctagtgacgctcagcacgctaggtattgttttgctcaaatataattaaatcaataattagtgtgtaacgaacaccccaagacaacttagatctcggagacacgcccaccatgaactaaaacaccgtcatttcttaacatttttcaaagcttggcggaatccgaaacactgagagcccgtgccaccgtcgcaatatccttcggcgttgtgcgacaacagccgccgataatgcgggccccggcggctaaccactgggggacaaaggatgcaaattgatgactcaaatgagtttcttgccaagtcttcgtcacgggatcatattgatcaccagaattaggataaacgatcaacggaaccgctacagcagccttcaaagtggttaacgctggtgcaatgttttccagcgtagtgcaattgacccccacagcgaccacgttcggctgggccgccacccactttgcggccacagctaatgacgtcccatcacataatgtctgtggatccttgatactaaagcttacccagtatggttgttgcgtccaagtggttgtgattagttgtaccaaagcctgtacttcgtctaaacgtggcatcgtttctaatgcaagcacgtccaccccggcggccatgatcaacgccaggcgttcgcggtgaaagtcttgataggcactcggcgttaactgatatgcacccgtgtactcactaccatccgctaagtaagcaccgtacgggccaatactaccagcaatcacagcatccgtgacatgactagcatcacgcgccgtatgagcaattgtcaccgcctgttgtatcaattgacgcgcttgtgcggcagcaataccagcctgctcaaatgcaggcacgttggcctggtatgtattagttgtcatgatttttgcgcccgcatccagatagctctgatggaccgcttgaatcgcatccgggtggtccaacattgccgtggctgaccacagtgcgctattggttgccacgccccgtttttctaattccgtagccatcgcaccgtccgagacgactgggccccggttcaattgttcagttaatgaaagcattgcaataattgccttcctttctacttataaattatgttattctaatagcattgttgattttttaatcatagtctaatcatattaattctgcaagtaaggaaggccggtacattatgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcctggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaagcggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacgactatgctaacggtcaactttgccttttccggaactgagctaattggaattacagctggtgagactaaggatccggcccacaccattccgaccgcaatcaaaacgaccctctggcgcctgattattttcttcatcggtagcatgtccgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaaacctacctgaaaagtgggcagtcgcttgatcaattgacctttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaagcccgttagtcagctcaactcaccaagtccacccagcaatcgtcttttgatgctgacgacctgaaaacgaacatggtcatggcttttgctggcatttctgaatctacttttaaagtacgatccagccgacgacaccgatttttgaactgcaacaaaaccaaatatcaatttcagatctcttgctagcccggccagttgctagcaagagattttatttatttcagcagtaaattgattatcactagataatcgaacaaataaaccattaaccccgtatacaagctgacgattatgctatgattaatttatcaagagcattggaggggtttctatgcacccaggattattactcgtcaatttaggctccccagcatccccacggactaaggatgtcaaaacatacttacaagaattcttaagtgatccaagcgtcatcgagatgccagccgcactctggcaaccgctgttgcgtggtattatcttaccgacccgttcttggcgttcggccaccttttatcaggatagttggctcccacaaggctcaccattaatcgtctacagtcaagccatctgccaacaagtacaagcagcattacccgattgggacgtccgactagcaatgacgtacggtcaacccgatatcggtgcgaccttgaaagccatggttgctgatgggtgtgaaaagccaattattttaccactttttccgcaatacacccagagcacgcacggcggcatccatcgtcaagttgaagcaactggattaccacacacctttatcgacagtttctacgaccaaccgacctacattcacttactagcaaccaaagtctggcaaagctatcaggcgcatcattatgatgcggtcatcttcagctaccacagcatccccactgcaatggtccgccatggtgatccctatcaacgcgaatgcgaggccacgaccaaagctgtgttggcggagcgaccagaattaccagctgataaggtcattacggcgtatcagtccaagttcggaccgatgccgtggttgaagccttacttaaaaaatgagctcatgcagttggtcgaacttggcaaacgcaacgtattagtagttacgccatcctttgtcgtggactgcttggaaaccctcgaggaagactacgttcaaaattatcaaacctttcgggcaagcggtggtgatcggtttgacttagtaccaccgatgaataaggataccagcttcagccaatttctggctgacctcgctatccaaaagcaggaggcgtcgaaccatgcaatcacatcgtcatcaaagtcttgaagaaatcaatcagagcgtcgcggttcccgacgttcatcagacggccttttggcgcaaatttttagcctatagcggtcccggtgcactagtggcagtcggctatatggatcccggcaactggttgacatccctagccggtggcggtcagtttcagtaccggcttttagccgtgctcgcattagccatcattgtcgccatgttcatgcaaggcctggcaatcaggctaggcgttgtagcccggcaagacttagcacaagccatcgctagcaagctgccccggcccgtgcgttacgccgcgtggattttaaacgaagtcgcgatgatggcgactgatatgacgggcgtaattggaaccgcaatcgccttaaaaatgttattcggcttaccactacttgcaggaattttactgacgattgcggacgtcttagttgtcttgttgtttttgagatttggcattcggcgtgtcgaagtaatcgtcctcgtcgctattttgaccgtcggcattatttttggtatcgaggtgggacgggcccacgttcaatttggcaacgtgttgctcggcttagttccaacaccattgatcgtcaaaaatcataccgcactagtcctcagtctcggaatcttgggcgcaaccatcatgccacataacttatacttacactcatcgcttgcacaaagccggcgttatgattatcataatccagcccaagtcacagaagcactgcgcttcgccaattgggactcaacagtgcacttgattgcggcttttctcatcaacgcacttttgctcgtccttggtgggacgcttttcttcggtcacaccaacgcgttagcgagtctgcaggccgtcttcgatgggttaaaaagtaccaccgtggttggcgcccttgctagcccggtcatgagctggttatttgcattagccctactaattaccggcctaatttcatccatcactagcaccttagctggtcagatcgtcatggaaggttatttacacatccgcttaccgctatggcaacgccggctgcttactcgcgctgtcacgctaattccgattctgattatcggtatgttagtcggctttagtgacgctgcctttgaaaacttgatcatttacgcgcaagtggcactcagcatcgccctcccctttaccttgttgccactagttgcgctgacaaatgacgccagcctgatgaaggcccacgttaatcgcccggcggtaacgtgggtgggatatggactggccggaattattacggtgttgaatatttatttggtgtatagcttgttttgagatgagatccattcacatagctactttgacttcagcactaaactaaaggccgtcaaccgcgaagcatatacgcagattgatggccttttgatactccaactcaattatcgtggatactaatttcccaatttttagcgataaatagtcataccccgcaatgtatcttctatcagacagtatcgcaacgttatcactagttgctatgctaggtaaaaattccccagtacaacccgcacccatgaatcgcaacagtcccaattgctaaaatgaccattttagccaagctacatgcccaatatcaatggtgctggctcgaatcatattactaaataacattgaaaagacaacaagacactagtcaaattaattgccagctttagtcgaggcgcatccgttacgttaacttttttgtaaggtgtcatcatttatccaaaacctctttcacaaacaattagtttaaccactatatttagaagcaatccattcagcttaaacaatatcacaccatatgtaagtcaccttgaactctgggcaattacatgtgtggtaacccacccgcattccatgtactgatacaattaaatgacaccaaccaaactaatcataaggcactatggtaaaataaaaaccgtgattatcgcaaggataaccacggcacgaaacgaattggcttgaatatacgtgctatatattacttcgtttcatacccattataacagataaaagttacgatggcttttcatagtggttacattcataaatttttaaaacccacgtttaccagaataaaacatctcaccagagtttagattacatagtagaaaggaagcatctcaacatggtaaaaattgcagtcctatctgacgttcacggtaacgctactgcactcgaagcagtcttagcagacgcccagaaacaacacgttgacgaatactggacagtaggcgacatgaccgttcgcgggccagaatcggagcgctgtctcaccttactagaccgcgttcaccccaccgcctacgttctcggaaatcacgaggaaaactaccaaaaagtaatggcagccaatcccaacacgtttactaaacccaaacaaattatggcaacggttctcaccgcttttgatcggcgccagctgagttcgacacactttgaacggttactgaacttaccaatgacagtcatcaaacacgtcggcccgttaaccatccgtctccaacacgttttaccgaccgtcgctagtggacacgcgctcgcaccaactgccagtcaggccaactttgaccaagccgctgaaggcgatgtcgatatcgtcatctacgcgcacacacaccagcccatcatgcgctacgcaaccacgggacagttgattctaaacgccgggacagttggtcttccgactgccattaatccccacctacgccaaccacgagcaaactacttgcttctgacaattgatgagactggcctccagcatgctgattaccgcgccgtagatttcgattggcagcgtgctatcacgattgcgcaaaatacccacttaccctacttcgaattctatgaacaaactttgcggactaatacttaccaatatgcaccgagtgcggtcgctgcttataatacgcaacatgacatggcccaagaagcgcgcaagattttacttgaaaatcgtcactgaaaatctcctaagaatcgggagaaaatagtttcatttttctaaaaattctgtatacttttaaaagtcgattactgcttcggcagtcaatcgctgttcaagagaggagctagaattatgtactttaaaaaagcgaccctcgatgatctcgatacgatcatcgacattctgagtgacggccgtaatcaacttgctgaagctggggtcaaccagtggcaaggcgactacccgtctcgcaaacaaatcacggccgacatcatgcaaggatcagcatacttattcaatgccgacgacaacgcaacggtcggcgctgtcgctgtcgtgccttcaccagacgaaacttacgatactgcgaaggccgaatggttaaataccacggcaccttacgtcgtgattcaccgagtcgcgattcattctagccatgcaggtcatggttatgccactcaattattcgaaaaaatcattgctcatattgctgcggatcatcctgaaatcaagagcatccgtatcgatactcatgccgacaatcaagcgatgcaacatctgattgcaaagatgaacttcaagcgagttggcgaaatggtcggtgtataccatgtcgatgacgtttgctacgtctatgaaaaaatgctctaattaatctgagaacctgaccacttgtggcaggttctttttttacgatcaaatccaatcagtcatgctaaatgactactcgtttgcggcagttgtcacagctaagtccttttgctcagcaaatacacaacgagtggctgtttgattcttataaccggcgcactagttgcagcccgattaagacaagcttggcttcatttttgtaacaaagtcgccagtgctgcataccgtttgcgccagtccaaaatagttagcgactcacagggttgcgttaatagccaatccaactgtgcttgccggtcaggctgatctaagaagacgtaactccgcggcgtaacaaagttttcaaactgacgacgtaactgtgccaacggaatgttaggtaaggttgtaaaagccgtaatcggtaacgccaatccgactttagctccttcaaaataagccgcggtggttgtgggcgcgtcatgctgtaacaatgcgcccacaagcgctaattgttcaggcacgagttgcatgccctgatcacaacgcaaaaagagttgaattcccccattagcccctgtcgtatagacaaatgcttgaaacggacgtgcaaaaaaacgccgacgatattccagaatcttggtgccattgataatcgcttgtgttggttctggatgcaacgaaaataataatgttggccgctttggcaagtaataatctttaatcgttggcatggtgccacccctccttcactaattagcactaagtataccccatttgcgagcgtgcgccaactaatcgtgattcgtgaaaacacgaactataaatagttagcaaacaatattattctgactttgtcctaaatttgctggatttaaaccctaatcagtcgtatattattcgtataaacaaaaaaggcggtattaatatgcattggttggcggatctattggcagcaatcggggtcgttttaaacgggatcccacaaggaattatggcgatgagtctcggttttgcggtctttccgactgcattttcattcggattagttggtttaatcaacggcgtggctagttcagttgcaccggtttcatttcaagcggaatccctcgcactagtcgggcacctgggacacgatttacgcgaacggtcgtcgattatctttttaggtgcgagtctgatgttcgtgattggcttgaccggtactctgccgctcatcgttcatagtctgggcaatcagcttatggcagcgatgatggcaggagttggcctgatgttggctaaaatcgcgttgcaaatggcgcacgaacaaccccaatttgggtggctgtcaatcggcttggcgggtgtgacttatttgatcagtaaagatttagtatggacaattgccgtttcagtgattggaaccagctgttacgcagcgacgacacattatcgcgtcgcactaccggaacatgtgacgacccgcaaattacaatttgtcaggccacagttcagttttaaaatcctgcgaggtgctctgagtctagcttgtcttaatatcggtgctaacctctcgtacggcttaattactggccaaatgacgggacaacaccccaacccggtcaatctaaatctactgactagtagtcaggcattagcagacctgggaactagccttctgggtggtgcgccagtagaaacgattatttccgcgacagccagcgcgcctgaaccagtaatcgcgggtatcctaatgatgttgatcatgatgctgattctattactgggatggctgccaaagctgggaaaagttgtgcctagcactgcaatcgccggttttttgtttatcttagggaccattgtcattttcccggaaaatgcaaccaccgctttgcacggctcgttaagtacggttgcaggcgtaacgctcgtcgtgaccgcccttgtcgatccattcgcggggctaatgaccggggcactcctaaaatttggtttaccattaattggattggggttataaatatgcaaacttatcagttaacattaggatcgctgacacggcagttaccattgattcgattaaatgccacgactagcatcgcctctttcgttctattgggcgacgctgagctgaccggctatgctgcccgtcagctcagtcaacggctaactaccactaaatttgattatttagtcacgatggaaagtaagggcattccgctagcccaggcactaagccaggccacaaaccaccctcgctttatcgttttacgtaagaatcgtaaggattacatgcagcacccgcttatcgaaccggtaagcgcaattacgaccagcaccccacaacagctagttttagacggtactgacgccgcactaatcaatcataagcgcgttatcattatcgacgacgtcattagcagtgggggctcgttgacagctgccaacgccctcctacaccaagctggcgcccaagtggtcaagcagatggcaattttagcagaaggcgccgccagcgaacgaacagatatcgattttttggcaccgttaccattatttgactagctgcggttcagaaacacattacaactcactagcgagtcacaaagcagaacaagcaccatggacttaaaccaactacttcagttatcaccgagtgcaacgagcaagttttagatggatggattcgttttaaagacctaccataatatgaaaagccctatgttagcatgatttatgctaatacagggcttttcgatgcttacgagactatttctacgttcatattcatgcaatgctaatattgtaaatttattctttgcaattggaaaattcacccaaaaatcattttgcctattttcgcatgattctaagaatacaaaaaagccgttatatcaacgatataacgacttcttaaaggtacttagagcttcctgaaaacctcttagtaccggcgatcggggtcgaaccgatactccctcaacgggaactggattttgagtccagcgcgtctgccaattccgccacgccggcaaaataataactagatggaacataaatctgatcaggattataaccttttcaggaaaggcggtaaccggatttgaaccggtgatgaaggttttgcagacctctgccttaccacttggctataccgccatcatttattgcccaaacccaactgggttagctggattcgaaccagcgcatgatggagtcaaagtccattgccttaccacttggctataacccaatcaaagggcggtaggtgggaatcgaacccacgcgtgccggagccacaatccggtgcgttaaccacttcgccactaccgccatcatggcagggatagtaggagttgaacccacaccgacggttttggagaccgttgttctaccattaaactatatccctataaagaatggaggggagtggattcgaaccaccgaacccgaaggagcggatttacagtccgccgcgtttagccagacttcgctacccctccataaatggcgcgggacggaatcgaaccgccgacacatggagcttcaatccattgctctaccgactgagctaccgagccatatcattcttcatgatggagtctattaaattattgatgagtaactctcatcagatggaggatacagggctcgaacctgtgaccctctgcttgtaaggcagacgctctcccaactgagctaatcctccataatgacccctacgggattcgaacccatgttactgccgtgaaagggcagtgtcttaaaccacttgaccaaggggtcatatttattatatctaactaacggagagtaagggattcgaacccttgaaacaggtataacccgtttacagcatttccaatgctgctccttcagccactcggacaactctccatggcttaccgtagataactccgacaggcgggctcgaaccgtcgacatcttgattaacagtcaagcgctctaccaactgagctatgtcggaataatcgcatggcaacgtcctaccctcgcagggagcgatcccccaactactctcggcgctaagaagcttaacttctgtgttcgacatgggaacaggtgtatccttctcgccatcgtcaccacactattgagaaacttgtgctctcaaaactagctaatatcaaatatcttcatatgcaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaagtactcactagaagcttttctcggcagtgtgacatcagacgcttcgctactaaatttcgctccccatcacagcttgtccttaaagtgaaaagcatttgactcttcaccagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagtttcaatgacgactaacgtcgtcaatggagaatagcgggatcgaaccgctgaccccctgcttgcaaagcaggtgctctcccagctgagctaattccccatgaggtattcaacttatggaaccaactggttcggttccaatgggcctaaatggacttgaaccatcgacctcacgcttatcaggcgtgcgctctaaaccagctgagctataggcccaaaaaacgcttattaaattgagagttagacctctcaaaactaaacaaagtttcgaagaatgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaagctcggaccatgcggtccaagttgttatgcggtattagcatctgtttccaggtgttatcccccgcttctgggcaggtttcccacgtgttactcaccagttcgccactcactcaaatgtaaatcatgatgcaagcatcaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaaggtctaaatcgttcgttgattacctcaacgcaactattaaagtttatcatcatcagaacaagctgtcaacatctttttataaattattttgaataactattcaatgtaaatgctcacatcaatttgaatattcataataatgagtaatgttgcatatcgctcttaacgacaagaaatataataccaagaataacgacccgggtcaaccctttttatgaattaatttcagaaaagttttaaacaccgattaatgtcgcaatagactatattttacggggtttttattaagatagcaagcaaaagttcaataaatctccctttaattttcaacgactgtttttcaaagtaaaccaacgctagcataatgaatattatttcgctgacaatctaccaaatcaagacaaccaatcagtcagcattccccacctcatcaccgtactttatcggttcacaacatccgcgacgcgcctaccattccaactttgcatttacttgggactccaaaattggtaatacttcatcgttcaccatcagtgtcaattcacactgcgcaacaatcggcttaataatagtgtaccgcgctgtggtcaaaacaagtgacagcttacttccgcaaccaaaaagggataacgccgtcagcgttatcctttagttgatacgagttcgattaatcagaactactgcttgaactactactactgtcacttgagctagacagttctggtgcatccgtcttatacagactctccgttgatttgcccttatgcttcgagagaacactcgtcttcttctcagcttggatctctttcaatgatttgagggtcttagtcagcttataactatagtccgacttattgaccttcttaaagcccttaggcgtgtagaaccgtagtaagtcaccctggatgacccgatcagagagtgagagttccgtcgtcacatgattttgcatctgtttgacagtatccttctgcttcgtcgtcatatccgttagcttcttaccggtcttcgaatcatagactgtcccactgatcttcgtatatgtcggtgagacaaaatccccgttccggaaagccactgtctggttatgctgtttcgacagtaagtccgttccgaactggatgtaacccttgttcttgatccctaacaggtcaaaaatcgttggcaacgcatcaatttcaccaccatacgtgtggttaataccacccttgattccttcagaatgaatcataaatggtactttctggaattgagccaagtcgaaactcgttaccgactttttacccaataactgtgcaatggcagccttatggttgtttgaaatcccataatgatctccataaagcacaatcatactattcttatataagccggccttcttcaagtaactaatgaattcggcaaaggcttgatcaagataatgggccgtttgaacgtagccatcaacggttgaatccccggtcgtcgtcttatcgatcgactggttcttcttatccaattcgtatggatagtggttcgtcaacgtaatcagctttgcgtagaatggttgtggtaattgctccaaatacttaacagagtctttgaagaagattttatccttcaagccataaccaatattgtagtctgacttctctttatagtaagaagagtagaagaagtagttatacccccacgacttatacgcgttatcccgattccagaaactagccacatcaccgtggaaagccgcagtcgtatagcccttttgtgacaggattgctggcgctgcctggaacgtattcgacgtcccatactgcgtcatcgctgacccggttggtaaaccaaacaaggagttttccatcatcatttcagcatcagaggtcttcccttgcgccacttgatggtagaaattatcaaaactcaaagtactcttatcatgatagaacttgttcaggttcggggtaacttccttaccatcgaccttataatcaattaaaaattgctggaaactttccaaatgaatcacgaagacgttcttgcccttcgctttaccaaagtatttgacgttctcgccagcctggtttttcttgaggtaggctagcacactcttcatatcactactacttgcttgggcgcgcgtcgcactttccttttcggtctgatagaagctataccctgcatatgtgttgagtcccaagtacttaacgatgtagttgttatcaaaagtccgcgtcaataaatctgaacggtcatgttcagacatgccgaggtcaacagcaaacaacgccaccccaatcacggtcagtgttgcagcataccgaattttgaaaggccgtggatcgatccgaatgaccttgaaggctaataacagaatcagcaacacgacatctgcataaactaggaagtcggttccatgaatgatctgtcccaaactctttccgaggttattactagcagcaccggaactcttaattacccccgccgacatgaaatcagagaattcccggtaatacaagatattggcaaataaccacgtcgtctgtagggcgtcaatgatcatcataatccaatactttaagcgaccacggaaatatagggcaataccgagcagcacgatcgctgtcggaaatggattcaagaacaagataaattcctgaacgggtcccttaacccctaaagtaaactcgctcttataagcgatatatgtctttagccaaaataagaccacggttaggaggtaaaagcccaacgttgtgttgaccttcccaaccgtgttttttataaatttaggcatggtaatttcttcctccgttattgctattaacaaatccatattataacggttgcgtactagttagcaatatcttgaagatttcttcaaaaattcttcaacattacaacgcgtcataatatggatctatcgaaaatctatctggattttgggggaatctagttatccgttagcaaatcgtataattcaattgccacgaggtcaatgttatcaaattcaaacgtttggtctggattgaattcttgtaacgtgtacgtcgaggtagcgggatcatacgctacttgcccacgttgaacgccttccttttcgaaccgccgtgattgcacttcggttgcttcagttgtgcgcatggcttctagtcgtttgagaattgctgatagttcagatttatccattatactaatctcgctccttcaagttttgtttacattctagcaaaaaataggactaataacacgtttttttagtagaaagcccatttttaccacaaattttcacacttataattataccctaacttcctgctaagacggtgagaagttgtgctaaaattagaacaacttataaattaaaggagttcggatatatgacactatttagagacgatctcaatgaaaccatcagtcacattcaagtttcaaccatccgacagtttgacgaagaagttagtgcgatacctgatatggtcaagttaacgctcggtgaacccgatttcaacacgcctgagcacgttaaagcggctgctaaaaaggcgattgatgacaactactcccactatactggcatggcaggtctgttggagctacgccaagcggccgcccactttcaagagacaaagtacggcgtccactatgatgctgaagaccaagtcttagtgaccgtgggagcgactgaagctatcgcaactgcattaacgacgatctgtaatcctggcgacgccattatcattccgtccccaatctttccagcgtacatccccatcattcaagaagcacacgccaagcccatcttcatggatacaggcgttaacgattttgtcattacgcctaagatggtcgacgattttattgctgctcatcctgacgagaacttcaagggaatcgtgttaaactacccgaataaccccactggtgtcacctatgttgaagatgaaatcaaagcgctcgccgactgtttccatcgccataacttgtgggtcgtatccgatgaaatttacagtgaactgacttacggtagcgaccacgtctcaattgctaaattcattcctgacgaagtgatcctgatcaatggcttatcgaagtctcatgctatgactggctggcgaatcggcttcctgtttgcctctaaggaaatgacggcccaacttaaaaaagtccaccaatactacgtcactgcagcaaccacgattgctcagaaggccggtgttgaagccctcaccaacggaatcgatgatgcgcaaccaatgcggcaagaataccaagctcggcgtgatttcgtttatcaaacgatgtcgaagctcggtttcaaaatcgcacgtcctaccggagccttttatatcttcgcgaaaattccagctggctttgaacaagactcgatggcattctgtaaagacttagcacgcaagaatcagctcgcgattattccagggactggttttggtgccgagggggaaggctacgtgcgtctaagttacgctgctagcatggaaaagctccaccaggccatggatcgcctcactgcatatatgcaggaacctgctaactgtatcaactaagcaacgacagtccaccaactaactgtcctagttcatcactgttagtcatttcaatgactgaattggattcaactcaaaaaggtgcgccaactactcgtaaattacgatagttggcgcacctttatttgtcttcagcatcacacgatctattaagcgagcatcactttgcgaacgcatacgtgcccgtggtggtccgtttcgcgggcgccgttgcccattgaagtggtccaagcatcgtcagcgcttcaggcgtccgataaatgacttccttcgtcgttcctgacaatggatccgtcaatcgcaatttaagaacggccgtattagcagccagataatttggcgctgtccgatgtaatggccacaaagcaattttggtctgcgttattggctgcttactattcacccacagttttgaattgtacttcgtcaccagacgcactttggtctgcgtccccggaatctgataattgatgctcttaggtacaacctgtttatactgctcggtcgttttgagcatcagccgcaagttgttgttcgccgtaaactgccacgcaccgccaagtgttgttgcaatcatccggtggccgttctgccggtatgtagcgactaagcaagcaccggcctgattcgtataaccggtcttcagtccatcgactggcacgcggggatcatagtactcggcgcccttcaggatctccaccgaagttgggaccgtatacttatgaattttgactgaacgttgattagcaacttgaataacatcggggtaagcatcaatcaaatgttgcgcaatggtcgtcacagcccttgctgacaccagattttggtcctgatcgctggttcccttaatttttaaatcgtaatttttcaaatcagtattatcaagtcccgaagcgctaataaaactcgcatccaaatgccatttggatgcttgttgattcattaatttaatgaacttatcattactgccagcaacatactcccccagcgcaatggcaccactattcgaagaccctaccaaggtagctgcgaataactccctaaccgtaaacgtctccttggcgggcatcggcattacggataaagttgcactggttgccatcttacggacatttttgcgaattgggactgcatccgtccacttgatctgaccatgctcgatggcccgttcaactaaatacagcgtcatgagcttactcaaggacgcaattggtaatttctgatcggcattctgcgcataaacgacctgaccagacttggcatccatcacgtaggcggctttgacctcatccgccttactactggtcgcgtgtgccgctacattgcagctcaacaccccgctgactgtcgctgtcaacactagtccccataccaaccgttgtttgattaactttaacatagtaccttcctttaattcgtaaccgcgaaaaatgggtcgaacaatgatgtcggcccattaaaattactgttcttgtgaatccgaccggctaggtgccgcaatcggaatttcttctgctttttcaggccgcatcgccatggcgatcatccctaagaatagtcctaaataatacgttaagatccgccagatcagcatcgctaaaatcagcttactgtggctgggaatgaacttagcaaacaacgccgtgaaaccaaattcagcaccaccggccccacctggaatcgggaatagtgatgtcactaagaagatcaacacgttcaaactagtcaccataatcaaattaacatcatcgattcccattgcccgcataataaaatacggaatcaggtagtaaaacagtagctgtaagaaggtgacgatacaaacttcgaccagcatccgccagtccttggtcattcgaacgctttcttcgtagaacgaatcgattttttcactaatattgttttcaaacttggcaaatcgctcagctttcataaaccagctgaccgggatcaagacgatcttcaccgctcgttttgtaaagttataccagtacatcaccagcaacagaccaacaatcaccgcaaagtgaatcagaaaacctaacaaaacgtatagtgacaggtaacttaacttttcagctaagtaatgaaaaccaattaacatggcgaataagaaattcaataccaccatggcctgaaaaacaacaaacttcatcaatgcaactgaacttgcccgcccagcatcaatccctgattgtgccatcacgaagatttgggcaggttggccacccgaagaaaacggcgtgataccgttgaatagttgctcggctaaaggaacgcgcagggcactcttaaagcgatagttccgataacggtgcctgacaaacttttgcaccaccacggcttccagaccgaagtatagtccgacacaccctaacgcaactaataaccaccaccaattcaaagtgagaatatcgtccattagattgcttagtttgacattgcgcagtgagtaccacgaaataccgacgcctaacgcaaccattacgagtaatgaccagatattttttcttgtcattgactacccctcttttgcctgttgcaaataaaaatcatgccaaactttggcaaggcgctcttccgaataatcctgagcagccaaaaccgccttgtcatgcaagaattgcaacccggctggattatggcgtaactggtcgatctgtcgttgcatatcatcaacatcactggctgcttgatagtagccatcaatgattgcccggtacaaatctaaatcccggagcaatactggtgtcccacaactgaaggcttccaacacggacatcggaaataactcgttataagaaggcagtaagaaaagatccgccatattataatagtccaccaatttctcacgaggaacgatgcctggaaacgacagattagctggcgggttatccaccacctgcttcaactcctgataaccatccgtaattcggccaaacgagaacccaccggcccatacaaactggatatctggattctgctttgcaagcgtaataaaatcaggaacacctttccgatcctgaatctgaccggtcccgataatcatgaatttattttgatcatagccgtattgttggcgcaagcgcaactgtttagccttagtcatttcgtaaaattcacgtttgctgacaaaattcggaatatacgttacatctgctcttttgatatggtatgcttccaattttggaatgaaagtcgggttcaccaccacaatgtggtccatccgcttataaaatgagattaaataacgattgaaaatcatttggaatggtcgtggcaacttcaagctaccctcgagcgtctctggtaagaaatgcacgtaaccgattttacggcctcgattaggcataaacgtagacaggtaaaacattggattaaccgtatggtaatgtgaaacggcggagcgcccatatcgattgactttaatattaaattcatcctgccaatgggtccgcaacaaccgcatcaattctaaataggcgctgccgactccctgacccttgacggagtcagcttttgaaaacatggtaatgtctaacataattcgtccccttacgcgtcatacgtcgaataagcatccccggtttggcggtgctcattgacgatttgacacacgttaattactaatattcgccgatttatccgctgattcagaatacgccagctgtacgtcttgatagtagttgatcacttgcttgccgaaatactctgcggaaatttggtaaagcttcttctgccgtggcttgggatcgttaaaagtattgggatgttgtaaataacgcacaacatccttgatcagatcggtctcacttgtaaaggtcgtccccagtgacggatcatcaagtaattgatccgtgtacggactagcagccactaccgttttaaggcccgcagccattgcttcaatgtacgtcagcccctgtgattctgagttcgaagccgaaacgaacaggtcagccatctggtaatagttataaacttcatcattatcaatttcaccggtaaattgtacgtgcgccgttaagccggcgtcttgaacctgattttccagtgtttcacgtgccggaccatcacctacaatcaggagttgggcattcggcacctgttctaagatcgccggtagggctgcaatgacttcgtgaatgtttttctcgtaggccaaacgactcaaggaaagtaatactggcgtatcagactgatagccgagtctttgccgataatccaccgtcgactgctgctcgtactgattaatgtcgattccagtcggaataatgcgaattggcgctttaacgccgtagcccgtcagtgtatttgcaacccgctcacttggtgctacaatcccgttcagatgataacaatacgcccgtgtggcctccttaacgtggtatggctttaacaacttaccattcgcaatataatgtagataatcctcatacatcgtgtggtacgtatggatacatgggacttttaattgtttggcaacaaacttaccaatcatccccatggagaattctgtctgcgtatgaacaatatccaggccaagatccttagcaacctggtaagccttaaaaagcccgcgaacggcgatgcgccgatccgtgaacgaaacaaatggaatactcgtaaaccgaaaaatattgcgttcataaatattcttatcaacatggggatccgtggtcgtaaagatatagacttgatgaccagcccgttcgagttgattgcgtaacaccttgattgacgttgcgaccccactcacttgtggatagtatgtgtctgtaaatatcccgatattcacgtagattctccccttatttccatcaattaaccgtgctgctaatcgatgttgcttaaccgcgcttagatcattatttcatgatcatcacgaattcgacttaatgcctatattataaacattatattggttaaatatccgagttgcaaataatcttaatataaattaagagttcatgacaaaatctatctgaccagctacacctatagaaaatgaattcgaaatgatgaattgtaatcgctaggcatcactcaacaccgccattacatcgtttccactacaccaactcttcaccgtcaacagcgagtagcaatgtgccctgtgtccatcattgactagcgcggtcgcaactatggacaattgtcacaatgcctaaatgtccagtcaattcgcgtcatgcactgtgccagctctcatcataccggtgcgggtagtccactcccccgtcgtgctaaacccggggctagtaccaactggttaatgacccgcatttacccacaaaaaaagagcaaatccgcagatttgctcttagtttgattgtttatttaccgaagacgttcttttcaactaattctttgacttcttcgttagtaacacactcgttaagtgccttatcagctaatttagccatttccttagtatcaagtttcttcattaatgaacgtgtcttaagcacggaagttgaactcattgagaattcatccaaacctaagcccatcaataatggcaccgcaatctgatccccagcaacttcaccacacatacccgtgaagcggccgttcgcgtgagcagcgtcaataacatgcttgatcaaacgcaacaacgatgggttgtatggttgatacaagtatgacacttgttcgttaccacgatcagcagcaaatgagtattgaatcaagtcgttagtcccaatactaaagaagtcgacttccttagcaaactggtcagctaaaatagctgccgctgggatttcaatcatgataccaagcttgatgtcgtcagcaacaggcgtaccagctgcaaccaacttggctttttcttcctcaaagatagctttggctttacggaattcgtcaagcgttgcaatcattgggaacataatccgtaattgaccgtaatgtgacgcacgtaataacgcacgtaactgggtccggaagatgtcatcacgatcgagggaaatccgaatagcccgataacccaagaatgggttcatttcatcaggtaatggcaagtaaggtaattccttgtcaccaccgatatccatggtccgaacaataacgggtttgccgttcatcccttcgacaaccttcttgtaagcttcgaattgggtatcttcgtcaggtaattctgaactgttcatgtacaagaattctgaacggaataatccaatggcttcagagccagcatccaaaaccccatccatatcgtcaggtgtcccgatgttagaagctaattcaaagtgcttgccgtccttagaaacggtggcctcgttcttcaacttagcccattcagccttttgcgcaacaaagtctttagccttttgttggtaatcagcaacttcagcatccgttggggctactaaagcgtcaccgttgataccatccaagacgaccgtatcgccttctttgatatcagtcgtggcagattcagatccaacgaccgctggaatttcaagcgtccgtgacatgatggctgaatgactagtccgaccaccaatgtcagtaatgaagcccttaacatacttacgatcaagttgagctgtatcactaggtgttaaatcgtgggcaaccacgattacttcggagtcaattaaagctggacttggtaaggttacccctaacaagtggcttaagacccgcttcgttacgtcgcgaatatcaccggctcgttcttgcatatatgcattatccgtcatcgcttcaaacattgaaatgaaagtatcagtaacttccttcaaagcttcttcagcattgactttatcatccttgatcttaccttcaatttgtccgagcatttctgggtcagacaaaatggtgatatgagcttcaaaaacttctgcttcttcttcacccaagttttcaaccgctttgtctttaatgacctttagttcagccttggaagcatcgaaagcgtcatgtaaccgtgcaacttcagtatccgtatcggaaactgttgtcttttcgaatgataaatctggatcaactagcatataggccttagcaattgcaacaccatcactggccgcaattccttttagtaccttttcagccattattcagataatccttctttcttcatcgtttcagttaaagctgcgatagcgtcggcttcgtcggcaccttcagcagaaatggtaacgtcagcgtctttaccaacaccgagtgacataacacccatgatggactttaagttaacggacttgtcttggtattgcaacgtaatttctgagttgaacttacttgctgattgtaccaataaagttgcgggacgtgcgtggataccagtgtctgcgataacgtgaaattctttcttttccataactattcgatctccttcaagataaataaatttaaaattggttccgagtcaattcgagttgccgccaacacgtatactcaagagcccttaataatgatgatagcaattatccaattaaaatacaagccctttcattcaagctaggcctattaattggttgtcttaccatccttctcgaaatggtaaacaatgcggccatctaagtccgccgtaccaatgactcgtttacgatactcatacttcatataggcgtcgtgaaaagccataaattcatccggcgttacggtaaaactgtcgcgttcgccatgacgcaacgcttccattaactgggtataatccgttgccaaacaattaccgcctcctcaaagttaggttgacacattactgcatcattattctgatatttacgaacaaagttctccgccgctcactggctgttgacggtcaccaatgaaaaacgatgcgctgcaaacatcaaaactggtcaggctcgatacatgcaaaaaaaccgctttgtactataatatagacagacagttacatcatcacttatcctaaccagataattaatatacaacgaatccggttacatgacaagctatgagttgcgactatccagactattcagaaataattgaatcaatcaaccattgcgaattatcccggccgcacgtccagttttgaccctgaggcttttcacttgcaacagtccgtaaattcgctatactaatagtcaaaggtcaacaaaggtcaaagagccgatgaacctttaactatgatcctaatcgatttagttatatttctgatgcgaaaggtgtgtgacagcataatgctttgtgacaattgccataagaacgaagcgacgatccatttatatacgagcgtcaacggtcagcggcgacaaatcaacctttgtcaaaattgctatcaactgctaaagaatcaggaacagcaaccaaataacggagttggaggtgctgatatggcacaagatccattcggttttggtggtcttgacgacattttccgtgcaatgcagggtggcgttgatcctaataacgcttaccggcaacaacagaccccaccgacccagccagctggtcctaatggcggcaatcgtcgtggcaataacaacggcggtggcctccttggccaatacggcttcaacttaacagcgcaagctaaacagggcaaaatcgatccagtgattggtcgcgataccgaaattaatcgggttatcgagattttgaatcgccggaccaagaataaccccgttttaattggtgaagctggggttggtaaaacggcggtcgtggaaggactagcacagaaaatcgtttctggtcaagttccacaaaaactgttagataaagaaattattcgtttggacgtggcttcccttgttcaaggtaccggtattcgaggtcaatttgaacaacgaatgcaacaattaatgaaggaagttcaaagcaatccgaatatcatcctcttcattgacgaaatccatgaaatcatgggtgccggtaatgctgaaggtggtatggatgctgggaacgtcctgaaacccgcccttgcccgtggtgatttccaattagttggggccacgacattaaacgaataccgtgacatcgaaaaggatgccgccctcgctcgccggttccaaccggtcacggtcaacgaaccgagcgtggaagaatctatcaagattctcgaaggcattcagaagaagtacgaagactatcatcacgttaaatacgatcaagatgccattgtggcagccgtcaagttgtcaaatcgttacattcaagatcgtttcttacctgataaggccatcgatttactcgatgaagctggttcacgtaagaacttgacgttgaagacggtcgatccaaagacgattcaagaaaagatcgacgaggcggaaaagcagaaacaggacgccttgaagaaggaagactacgaaaaagccgcctactatcgcgatcaagttgctaagttagaaaaagctaagcccgatgaaagttcagaccagcctaataacgatactgccactgtaacagtcaaggacatggaacaaattgtcgaagaaaagacaagtattccagttggtgacttgcaggctaaggaacaggctcaaatgaagaccttagcacccgaccttaagagtacggttattggtcaagaccaagcggttgaagcagttgcccgggccatccggcgtaatcgaatcggtctgaacggaactggccggccaattggttccttcatgtttgtcggcccaaccggggttggtaaaactgaattggctaaacaacttgctaaggaactgtttggttctcaagatgccatgattcggtttgacatgagtgaatacatggaaccacattcagtggctaagttgatcggttcaccgcctggctatgtcggctatgaagaagccggtcagttaactgaacaggttcgtcgtcatccatatagcctagtcttactagacgaagttgaaaaggctcatccggatgtcatgcacatgttcttgcaaatcctcgatgatggccggctgaccgactcacaaggtcggactgtcagcttcaaagatacgatcatcatcatgacttccaacgctgggactggcgacagtgaagctaatgtcggttttggtgccgctgctgaaggcaagacgcacgatatcactagccggttgacggactacttcaagccagaattcttaaaccggttcgatgacatcattcaattcaacgctttatctaaggaaaacttgatgaaaattgttggtttgatgatcgaagatgtcaacggcatgttagctaaccaaggcttacacgtccacgtcacagaacctgtcgaggaaaaactcgttgaactaggttacaaccctcagatgggggctcgcccactccggcgtgttatccaggaacaaatcgaagatcgcatcgccgatttctatttggaccacggcgacgttaagaacatggttgcaaaagttgaagacggcaagattgttttggcggctgagacgaagtccgaataagataattaaatttagagccagaagcgtaaacaatcgtttacacttctggctcttttttgtgcctacctcaaatcctcattgagtcgctatgaatagcccgcgtctctgccataattaaacgcctaatttaaagtcccataattgtcgttccaaattatcacgctcaatgccaatatagcgttttgtcacctgctcgctcgaatgattgaaaatcatcatcaatccggcaatgtcacgagtcttttgataataatgatagccaaatgtcttgcgcaacgtgtgcgtaccaatatcatcccgctccaggtactcaccggccgtctgaaagactcgatagacaccattaacggttaaagctccgccccgaccactacagaataacggttcatttgccccccgataccgcgtaaagtgggctaattccgttttgaggtttttcaaaaacaaccagcgcttcttgcccgttttttgttccatgatcataacacgatctttgccacgtacttgcccaaccttcagtcgtaaaatatcactcattcgtaatcccgtgttaattccaaccaaaacaatcatgcgattacgctccccataacgcgcttgtgaaacagcccataaaaaatcatcgatttcttggtccgttcttagcggttcaacattataatgcatacgctccattacacctcaatcaatcttattaagtttaaattacttaacctagagtaaactaaacaaagtaattgttaacctataatgctccccactattaagtgctaaaacaaaagcgcgggacaaagagtctcccctttatcccgcgttaaggatattacttcacttaatatccgtgaacgtgtacatctgcctataattgcaaagctgataattgatccgctaactgtgttgctggtgtcgtgtcaagtgatttagtcaattgtgcatcaacatccttcattcgatcctgaccagccttcgtaagcgttaagacccgtaaacgccggtcttgtttaattggttgacttttcaaccatccttgggttatcaaggtgccaatattttgtgccaacgaggctttcgccacattcaacgcatttgccacatcaccaatctggataccaggatgttgttcgacataaactaagatccgtaactcgttcaaactaagccctgtggcggacgaccagttcgacgtaagtcgttttaagtcccgttcaaggtgcatgatattcataatataattaattggttgttgcatactaacagcatccttcctgaaatttgtacttttttcattaaccgttcaaaacaagccattgtcccttcgcatgatttttaaaaaaatagtgcgaattgattcctgttaaatcaatatttttgatacgattcgtcattgccgctcgataaccgtatccttgacgacctcaattaagtcaacgtttcactcgcaatatttttttaaaaatggtgcgaatcaattattaagacgaatagttatatttgttaacaaactttattaacaatattattattgcataattacaaaatttacacaaataactttgactaccggtcacagtttagctggtcaaaaatagccgtctatccccgatttaatcggctttttgacaattgattccatcaatattttttacatattaaatttatatgtcaagttaacatgagttaattataatggttattaattaataaacttatctaaacagttaattaaatattctactgaataataaaacagacgtcgagtattcgcactcgccgtctgttttattagccgttactcagaaaattccgtaattaaccccgcgtcaacagcccgcttggtgtatatcgggatttcgtcttcagttgcccggacaaagtgccctggtgcaatttcgaccattcgccgcttcttaccgtcatgttcggtcgtttcgtcataaggaacctgcttacggttacgttcaaactctggatcaggtaccggcaccgccgagatcaaactctcggtgtacttgtgtaacggatgattatacacttcatccgcaggcccaatttccagaatcttaccgtaatgcataacgccgatccggtcactgatatacttaaccattgacaaatcatgcgcaataaataaataagtcaagttctgcttaacttgtaattccttcatcaagttaaccacttgggcttgaatcgaaacatccagcgcagaaattggttcatcagcaatgatgaatttaggctctaccgctaacgcccgggcaatcccgatccgttgacgttgaccacctgaaaattcatgtggataacgactagagtggtccttgttaagaccaaccgtctccaataagtcttcaacttgcttggttcggtctgcatcatccttggctaaaccgtgaatatcaatcccttccgccacgatatccttgactttcattcgtggattcaatgaggcgtatgggtcctggaaaatcatttggatctcccggcgaaattcatggcgttccttcttagtgtgtaatttggaaacgtccttaccgtcaaaaatgatttcaccatcagttggttcatataagtgaatgatggaacgtccggtcgtggtctttcctgaaccagattcaccaactaacccaaatgtttcaccttcataaatgtcaaaggagacgtcatcaacggcccggacttcatcttttttgccgacattaaaatactgctttaaatggcgaacttctagaatttttttacgttcatcaggcatgtctacttactcctttgctacgggatttgaaattggtgcttgcggtttttgcatggccgcaaacttttgctgacgccgaacgatttcagcaggtggcgttaccttgggggcatctggatgtagtaaccaggtcgccgcgtaatgggtatcagaaaccttaaagaatgggggttccttctccgtatcaatcttcatcgcgtaatcgctccgcgctgcaaaggcgtcaccaactggtggttccaacaaatctggtggggtccctggaatcgctgataatgagccactttcagtatccaaggttggcatcgaattgagtaacccccaggtataaggatgttgtggattgaagaagatctcatcgactgtcccgtattccacgattttaccggcatacatcactgcgacccgatcagccattccggccacgacacctaagtcatgggtgataaagataatcgacgtatcaattcgattttgtaaatccttcatcaagtccagaatctgggcttgaatcgtcacgtccaaggcagtcgttggttcatcagcaatcaggacttcaggatagcagaccaatgcaatcgcaatcacaatccgttgccgcatcccgcctgagaattggtatggataatcattgattcggccttcaggattagtaatcccaaccaatttcaacatctctagcgcttgggcgatcgcttcttttttcttcaaacccttatgtttcatcaaaggttccgcaatctgcatcccaatccgcattgttgggtccaatgatgtcattggatcttggaagatcatggcaatatccttaccacgaatgtgttgcatgtctttttcggactttttaataatatcttcaccgtggaacataatgctcccacgtttaatttcagcattaggtgctaacaggcccatcagtgaacgtgtcgtcactgacttaccagaccctgattcaccaacaattgccaaggtttcacccttacgtaaatcaaagctaacgtcacggatggctttaacttcgcccgcataagtatggaaattgatttccaagttgcggacctcaatcacattttctggtttttccatagtgctgccgtcctcctaacgttttgactttggatcaaacgcatcgcgcatcccgtcacctaacaagttaaaggcgagcatcaagatgatcagcacgatggctgggtaccacatctgatatggcaagaattggaagttcttctgcccatcagagatcaacgtccccaatgaagcttggggtgaactgatcccaatcccgatataactcaagaacgcttcgaagaagatcgcacttggaatcgtgaacatcgtttgaataataatgacacttgaaaggtttggtaacaaatgtttccaagcaatcttgacgggtgattcacccagtgtccgcgcagccaaaataaagtcttggttcttcaattgcaaggtctgtgcccgagtcagccgggccatcgtggtccaaccagtgatcgcgatggccgcaatgattgaggccatcccagtcttcgtgaaggccgtggccatcaacaccatgataaccaattgtgggatggacgagaggatttcaatcacacgttgcatgaataaatcgacgcgcccacctttccaaccggagagtatcccgaatccgaccccaatcgtcaggtcaatcaaagtagcaatcaacgcaatttcaagtgagatccgggtcccatacataatccgcgccagtaagtcccggcccagataatcagtcccgagaagataatgcacgtcagactttgcaccggccgccgcatatgcatcaacgtccttaccagattgagtcaagtgaccattcaagccatggatactaacacccggaatcttcggagggaggttcgcataccgtggcgactgtgcattaggatcaacatggtagactgcccgtccaccaaatgccactaagaataagaatactaacacgataaagctgataaaagcggtcttgttagacttcaatcgccgccatacatcttggccgaacgttaaggaaggtgctgcgatccgttcattatcaggacccgcttgtttatctaacggctcgaagtcgccgggcttaatatcgatactacttggattttctgccattaactagtccccatttccatttaaacgaatccgcggatcaataattccgtagacaatatcggtcaacaataatagtaagcaaaggagtgctgaatagaaaatcgtcacacccatgatggttgggtagtcgttaaccagaattgatttaacgaattgttccccaatcccaggtactgagaagatattttcaacaaccattgaacccgtcatcaaggcggcggccaatggtccaatcagcgtaaccattggaatcaaactgttccgcaacgcatggtgatacacgatgccaaacttcgacaaccctttggctttagctagctcaatataatccgaactcagcacgtccaccatgtcggttcggataaaccgagccgtttcggccagcggactggcggccaaagctaacgttggtaagatcgtgtaagcgaagccttcccaaccagcaacagggaaccaaccagcctttaagccgaggtagtattgtaacaggatggctaacacgaaactcggaactgcgatccctaagatcgataagatggttgctaaacggtcggcccaagtatccttcttgatggccccaacggcccctaggataatcccaaagacgattccgacgaccatcgcttgaccacctaactgcatcgatggtcccatccggctaccaatcaggtaactgacagcttgatcagagaactggaaggataaccctaagctccccttgaagatcccgccaatgtaaatgaagtattgcaaccaaacaggtttgtccaacccgtattgggccaagatcgacgccttttcgctaggggtcaatttagcttcattttgcagcggtgttccgggcattaacttcattaagaagaacgtggcggtcgccacaatgaataatgtcaggaacaagtaaaatatccgctttaaaagatactttctcatgagaattcctcgcattctattaaaatcaacttaaaaaataatgacatccctcattataaaacaaaatggtaaggattaacaatgtgtcaatccttacccctttgcttcacattcattcagttaaagcacacacacttttttctgtggatttacatcattattttacggacatgtacttgaagttgtagtttgagcccgcagtgttgtagatgatgcccttcagattgctccgagtcaacgttgctgaggcttgttgatagattgggatgaccccttgatcattcatcaattgcttttcagcagcgaccatgtcagcccaacgtgcagtcttgttattggcatcggcaccttccgccttcttcacagcatcgtcgtatgcggcactgtcatacttcccattgttgtatgagttgtcggacgtgaagagtgacaagaaggaaattgggtcggtaaagtcagcattccaggcagagataaccgtatcgaagttcccgttttgtgaccgttgaagacgggtcttgaatgggacgttctggttagtaacggtcagaccaggtaatttctcccaagcaccttgaataaattcagtagacttcttaccaccatcagtatcgtcagaaagaagcttgatgttcagcttagtttcaccaatttctttcatcccttctttccacaacttcttagctttcgttaagttgtagtcaactgcagaaggaacggcagcgtcagtcgtaaagtccttaccagttgtcgggtttttagctaagtcttcagaaacgtaacctttagaaacggtcgaaccgttacctaacgtattattaacgtaggacttccggttaattgctaatgacaaggcctgacgaatcttcttgttctggaaagctttggctaaagtcttatcgctatccttacgattaaattcaacgtagaaagttgaagccgtcttccgaactaagtagttcttatcattcttataattcttaacttgttcgttggaaagtgtcgtaaagtcgagcttattggaattaaataagttcaagccagttgaaggatccttaacgacttggtacttgatgctgtccatcttaacagctttcttatcccaataatcgttattcttcttcaaggtccatgacaagtttgtcccagtccaaccagtcatcttgtaagggccgttataaaccatggccttactgctcgtcccatacttagaaccgtacttcttaaccactttttcattttgtgggaagaagttgacaaagcccatcagcttgtcaaagtaagcaattggcttatccaaagtgaccgtcaacttgtaatcgccatcagccttgatccctaaactagaaacgggcttcttgccattgacgatagcgtcagcgttcttaatccctgaatataagtatgcgtattgtgacgcagtctttggattaacggtccgttgccaaccataaacaaagtctttggcagtaactttatccccgttactccattttgcgttcttccgtaaagtgaacgtatatgtcttcccaccattagtaaccttagtggatttcgcaattccgggtgtgaccttcccgttcttaccgagacggtataacccttcattggtgttattcaacgcgttagaactaaccacatcggtggacttagaaatgtccatcgttggtaattcggctgattcggtccaattggccgtttgcttagaacttgaagaactcttgcttgagccacaagcagctaagaatagtacggatgcgccggcaacgacggttacttttgcagctgttttgaaattcatataacccaacccctaactttaaaatagtttgtgtgtgcttttccctcgaaaagttaaagtaattgtatattataaataaattaaaatcaatcctaaactctaatttttatcattatttcgtcataatcgtcttaattatttcattttgcgattattatccatactgataaacatgcctgaaattactgatatataaacaattatattctcacatcagtgttcaattatcaagtgaacacaatcggcaatttttcttaataaataattcaaataacgataaaaatgacgatattaggtcttttttacgttagtcaaaacagctaaaagtgcacaaataaaaaagaatgctgattttttatcagcattctcttattattaaacaatattggctagttaagtactcgtacatcggcataaaacacaccagcccgtgaatttacaccaacttagattctttccacattaacctcgaaacaagctggtagccattttagatgtgcgcccattttaatcacgactcaacctgattaatcagctccgtctagcctagttaccgagatacccaataaccgaagcaacaatcaagatgatgagaacaatcgtcgtaatccaaacatataagtgatctttttccactgcaaaggcgtagatagagaccgcaacccgcaaagttggcgttaaaatcaatagaaataaacctaacataatcacggcatatggtttaagtgccacaatgccggctagaatatcagcgaccgtatggggttccataccatttgcataaccaccattgccctgaatcaacatcagaagcatcccaataataatcacgattgcagaaacaatgacgccaattcgtagaatatacccaatcatcatttcaacggcgtgcatctcttgcgctttagttgttttttgcttatccattagatggtcaccccgaatcctttagcaatcatttgaattcccagatagagcatcacgggcacaaagatcatgcgaatcaagcgtggcttgagccgcgtcatgattcgtgagccgattaaggcaccgacgataatcccgatagctaatggggccgcgattccgggtttgattgacccattaaagaagtagaccatcgcactcgctgccgccgtcacccccatcatcaggttagaagttgctgatgacggtttaagcggcatatgcataatcgtatccatggctagcactttgaacgcgccactcccgatccccaacaagccactggcgaaaccagcaccaaacatcatggaaaaaccacccggcacgttttcaacctgataatcaacttgcttattcaatgctttatcataataagtaccatttaagttcaactgtgtcgccagcttgtcatctttgactgacggtaattcaccgttcttactcattaatttacgaatcatattatacgtcgtgaaaactaacagcgccccaaataggaagtacaggaatgttgcattaagcacccccgtcaacactgccccgaggacggccccgaccgtcgtcgcaatttcaagaaacatcgcgacgcgtaagttcaacatctcatcacgtaaatatgcaatggtagagcccgaactcgtggcaatcacggcgataatactggccccaatcgcatacttaatatctaatcccaaaccaagtgtcaggattggtgtgacgatcatgccaccaccgatacctaaaatagcaccgaaaattccggcaattaccccaacgccgagcattagccctaacgaataaatcatttccttcaccttcaccctttaaatttcaattgttagtgtaccatttaaaccgattgatatctaattattaaatgaaggttagcgtatccccagtacgacagtcattaggcttattttgcgtctgaaaacaccacttcaatttctagctagtgtaatcggtaacaacccgattaaatcagcaattcacccttaaccgcgattaaatttttagatatcaaactgattaaactagtctagcgactgcgcttgctggaattgtgccatcaaaccggcaactaatggggtcgctaaggcttccggggtcgttgctagggccagttgagtctgaaaacgatgatccgccaatgatcgaatcagcacgtcaccaccgtcataggtttcagccaatgaccgtggcaccagggccactcccaattggtgattagcccagtgcatcgccgtgcgggcatcatcacaagtcatgatgtaagtcggcgtaaccgacgcttccagaaaggcaacgtggaataattcattaaaacgacggtacttgatcaatggtaacgtagcgaggtcacttagttgtaactggcgccgcttttcaaaccgtgaatatcgcttcggaatgactgctgccatccgttctgcgggaaagtaacgacagactagatgttgcgcgttgaacggtgttcgtaacaccgccacgtctagcaaccgtttatgcagatcgtctaacaactcatacgtattgccttccgtaatcgcaagctgaacatcgggatgttgccctaaccactttagtaatgccgtattcggcatgacccctgccgaggatgaaactgtccccagattaatggtccccgtcacgccgtgtgccagggcccggaccttgttctccgcagtcgccgacaactgcgtgagctgttgggcataccccaccagtagcttgccagcttcagtaacagtcacaccctgaggcaagcgattgaagagggtgacgcctagttcaagttctaattgcttaatctgatagctcagtggtggctgcgccacgtgcaagcgtttggcggccgctgtcatctgaccttcctctgccacggccaaaaaatattgtaattgttttagattcatccgttaacgccccctgttattaaatattagtatacacgactgacaaagcgggaattttacaatttatttaagacgtgccagaacccttgtgaatgcgttatactagtgataattaatttattaatgaaaggagtggtcacgtgtcgtttcttgaccgacttaaaggaatgcttcaggcactaaacagcacggaagccgccacaagcgctactgaggcaccacgttccattgccgcacaaactgccgcagcacctacagttaaccaaacagaagcattagttctcgttcaccacctagatcaggatggcaatgaactgcaggctgctgatatgattgctggcaccattggcgaagagattcacttgccagccgtcagcatcaccggctaccacctcgtccatatcgaaggcttgactcgctggtttacgaccccacaggctagcatcacgttgacttacgaacgccaagctggccaaccagtctggatgtacgcctatgacattgaccgccgcgaactaattggccggccgaccatgtaccgggggaaattaggaaccccttacgaagtcagtgcgccgaccgtcgccggttttaagctcctccgttccgtaggcgacgtgactggggaatacacgaccacttccaagacggtcctttttttctaccgcaatcaaaattggcaacaaactgacctcagtactggttttgtccaagtcaacaagttgaccgccgtttatccgtatcctggggcaactacgaccaactatttaactaagctccagcccggtagcacttataaaacgtacatgcgcgttcgcttagtcactcacgagacctggtatgcgattggcgatgatcagtggattccggagacgcacctccaattaactaccggtgacacactgttactcaagttgccagccggctaccgcgtccaaaataaacggcctgttcgccaaaccggcgtcgtcagttttgtccctggcaaacaggtccacacatacatcgaaccatatggccgctatttaactaccgtcactcatggtgacacggtcaatttgattgagcgaatggccgacgacaacggggtcgtctggtatcgcctgcaagatcaaggttacttgccgggccgttatttaacgaaattagatccaccgtttgcttaaacaagacttttgttcgattaacgcgaaccatgctaaaatgcgccactcgctagcttcaatctaatctagcgagtggtgcattttaatatctacttatcaacaattatgcgcatcaactcgatgccccgattcgtcagcaagaaaccttcctggctgtggtgcatgaagactaacccttcaaactcgcgatcaccagcaaagttcgcctcaccgacctgactagtcgtcaagtgtcccagtttagccgctggaagtgacgtaatactctcatcggagaccaggtagagccgaccagtaacctcgttatatccaatcgattgagcgaagaaacccggattattagctaacccctgcgcgagttgttcaaaatgtacaccagtcgtcgaactgattgtgccacgataaagcgtgacattgccatttctgagctgactcgcatgcgtccaataataggcctgcccagcgcgatcaaaagtcagttcatcacctagacgcccgctaccagtagtaaaggcaattttaagatccggcgtcagggattgcggatttagtcgcgcaacacttgcaagctgatcacgtgccgtcgatgaaataaaccacagctcgttcgtcttaggatttaaagctagtgactgaacgtgtcccgccgtaaactccggccccacttcaatggcggccagcacccgacggtcaaaagccgtcatcttcccgtcgaattggtgagctgctgctactcggaccatcgccatcttccctgattgcccagcccctaaagccatcaggcgttgccaatcatagcgaacgacccagccagtctggtcggcgccacccaactgttgatcattgacgtacatgacgtacaagtaccgattgtcagctgaaaacgtcgcactctgtgggtcattcaacaagcggctccctaactgttgcggtaaatacagtgctgttttgaaatgataatggtcgcgatagccactactctggcgcaacgtgtctggctgattttgtagcccttgagtcgctagatacgcggcggtaggacgaaacaaaatatgctcagtggtgtaccgtcccgccccttttaagggcaaataactcagcttattggccgcgcgcgtcaccccgtgttcctgttgatccgttgtcaccacgcgcatcggttgccgcgtgggcgtcttaatatcagtgaccctggttccgacaacccgtacggtgtccgccaacgcccaactcagtcgcccagcagtcccgtgacgcacctgccaataagtcactaaccgcttgttttgtgtcaccatcacctgaccaacccgttgccagtgactagtcgtccgggccgtcccacgtggcgttaattgcatcgttgcacgatttaattgatataagcgcgtttgtttcgattcaagttcacaattccggggcgctaagctttgcaccgctggccaccgtaccaagttcgtcgccgcgtgcaccgtcatcgggccccacaaccccattcctaacatcaatcccagcatccagcgtccccttattttcaatctcatcgccccctacaatctaaattgcagattgattgtatcgtaattctctcaccttagcagtgctacaacgttggtttacatggtgaatttacatggaccgataagcatgttagaagaacctctcatatcacttctatccggtcccgccacacaaaaaatgatgagaccgccaaatcaacttggcagccccatcattttatgaattattcgcatatttgttcgtgcttttgcttgagacacgttgtaatttttctatccgttaaatcaagagcagccagcttaggcccactgggaaaagttcgagttagcgtaaacttttttggtaggtgcgtcctacaccgacttccaggcatttctgccaattgctggaacgcggtggacacagatttaagccgaagaccacgtcttaaatactgactggtcttccactaaccaagccaaagacgcttgctaagtggaatttcaccgctgagcattggcagaaacgccttccagtcgggatagtattcgaatagcagacggtgaggggcccaatttttgatgaatcggtcgttgtttttcataaacggtaattttgctaagcaactatcagactgaaaatgatattggaatagctcactatcttaagccgctgtagtcaaaattgaatgtgcgacaaagtcgtttatgcaccctgatgttttattcaaagttccagtatcaaaatagttagcgcccaattgcaccaagttaagtggccgttcatcagccattcgagcgggttcccgaaacgtgctcggtgccactgaagcctgtgcttgctacgccaacggactaatgccaaaaccgcattaatccgttggctaggcaatgctcagtagccaaattattcttagctggaagtgattttcttccggcttagaataagactcgtatttgagctaacgcgggttgtgcgttaactcaaattgatgtcggcttacgttccagcaatagtcacccagccccggaggtcgaaataggacgcacatcgactgacgaacagtaatctaactagattggtcagctaagtgtaaaccacaatataaatcctagagcttcgaggtcagcttgacatccggatacttatccgcaaaccagcgttcggcaaaggcattttcgaataagaagagcggtgccccgtaacggtccttgaccaatagattccgcgaactagacatcttttcatccaattgttcgggatcgatccaacgggcagtcttgctacccattggttccatgacaacttccgaattatattcattttgcatccggaatttgaagacttcaaattgaagttgaccgactgcaccgagaatatagtcacccgttgaatatgaagtgtacaactgaacggcaccttcttgaaccagttgttcaatacctttatggaaggacttctgtttcatgacgttcttggctgtaacgcgcatgaagagctccggcgtaaattgcggtaacttttcgaattgaaccgcatttttgccagcgtaaatcgtatctccaatttggaagttacctgtgtcgtagaggccgacgatatcgccagcaacggcagtttccaccgtttcacgggtatcggccatgaattgcgtagagttgtttaagcgcatcttcttaccagtccgctgcaagaccacgtccatcccccggtcaaattcgccagaacaaatgcggacaaaggcgatccgatcacgatggttcgggttcatgttggcttggatcttgaacacaaaaccggcaaattcatcgtcggttggctgaacgacttggtcatcacgagtcttatgagcagcgggtttaggcgcatactgcagatacgtcttcaagaacgtttcgaccccgaaattggtgagggcggacccaaaaaatactggcgtcatgtctcccgccattactttagcttcgtcaaaatcattaccagcttcgttgatcaattcgacttcatccaacgtgtcacgataaatactgtccttggtcaattcattactaggatcaagctcaccgttctcgtctagtggtaagaacgtttcgccatgagcttcattatgataaagttccacacggtgattgtaacgatcgtataagccctttaagcccttacccatacccattggccagttcattggataagtttcgattccgaggacttcttcgacttcgttcaacaagtccaatggttcgcgaccatcacggtccaacttgttcatgaacgtaaagatcggaatgccccgcatcttacaaatttggaataacttcttcgtttgtggttcgatccccttagccgagtcaatgaccatgacagcggaatcgaccgccatcaaagtccgataagtgtcttccgagaaatcctcatgtccgggcgtgtccaagatgttgatccgtttgccatcgtaatcgaattgcatcacggaactcgttactgagattccccgcttcttttcaatttccatccagtcagacttggcaaagttcccacttttacgggctttaaccgttccggcctgacgaacaacgccaccaaacaataacatttgttccgtaatggtggttttcccggcatccgggtgagaaataatcgcaaaggtacgccgggtattgactgcggcggttaattttgtcttattcattaaaaattcctttcatcataacctgtatattcaacgtgcacggtggtaccgtcccaccgtaaaaaaacatagccttacatattttactgatatttgaccaaaaaatccagtaccaccgactatcttgcaccgattcggtggaaattcacttaacaaagtcatgacagaccagttgcaatcgatttcagggccatacttttaaattaaggccgcgttttatttggcatgttaaattaagttgtgtacaatgtatttgtttttaaataactgtgatttgggaacgaggaggattttaatatgtcagaaaaatttgacgttgtatatctaggtagcggtcacggaacgtttgacggggccattccgttagcggctcgtggcaaaaaagtagccgtcattgaagctgatttgattggtggtacctgtcctaatcggggttgcaacgctaaaatcaccttagaccagccggtagcattaaaaaatcaagttgctaacttccaaggatacggtctgcgtggtgaaccgacgattgattggcaagccaacttcgaccacgaacgcgacgtcatcgccggcttaccagatatgattgctggcttaatgactagtgccggcgtgaccctcatcaatggccgcgggacgttcgtcgacgaccatacgattcaggtggcggacaagacgtataccgccgataagattgtcatcgcaacaggtcagcatccacatcgtttggacattcccggcaccgaactcgcccatgacagtaacgactttttgaatctaaccactttgccacaccacatcaccgtgattggtgccggctacatcggactcgaattcgccaacatggcactaacagccggcagtcaggtcaccctactcatgcgtggtgatcaagcgcttcgtcaattccaccaaccattcgttgaacgattattggccattctcgtggaacaaggtttagtcctaaaacgtgaatgggtgccaactgcgatcaagtcgactggtgaccacttcgaagtcctcagtgcggatgacaagattacaacggactggatcttagatgcgacgggccgccagcccaacaccgcaaacttaggacttgaaagaatcggtgtggactacacagcagctggaatcaccgtcgacgaccacttgcaaacgagtgtcgctggcatctacgcatccggtgacgttctcgccaaggatcaaccaaaattaacacccactgctatctttgagtcgcaatacctgacccacctattcacgggtgacaccaatgcccccatcaagtatccggccattccatcggtcgtcttcacgtccccacgattggcccaagttggtacacttccaaccagtgacactcatgatgtcaaagttaccgtcaatgatttaaaggatgactggttccggcagacaacgcgcgatgtcaccggccataacttactcgtgacggatgaccagcaccggttgattggtgccgctgaactcggtgaacaggccgaaaataccattaacacgttgctaccagcgatccagtatcaattgacaccggcgcaacgtgaacaactcgtgaccctcttcccaagtatcggcgcagccgtttggtcagcaatttaacaaattttttcttggcaatcaggcctgtaaaaccgggcttggttgccattattttcagtctaatgaaaataatttacaaatatatggttgatttatgtaaatggttttattacaatgtaagcgaatacaaaaagtacttaatatttttcatataaaagaggggtttcatcatgaaattaggattgattggcttaggtaaaatgggaatgaacttagcgttgaacatgcaggataacgggcacacgccagtgggaatggatcttaaccccactaatcttagtaccaccagtgctcacgggttggcgacggccacggatctcaccaatttgcttgaccagttgccaacaccacggatcgtgtggatcatggtacccgctggtaaggcaaccaacagcgttatcgaacagttagcccagactttaagtgcaggtgacatcgtcctcgatggcggtaattcgcactatcaagatagtatccgccacggcgaattactggcaagtcaccacatcaacttcttagatgtcggaacgtcgggcggtcaagctggtgcacgccacgacggcaattttatgattggtggcgaccccgccactttccaagtcgtcgaaccactatttaaagcgattgccgctcccgatgggtatttgtacaccggccctgttggcagtggtcattacctgaagatggtccacaacggaattgagtatggtatgatggcagcaataggtgaaggctttgacgttttacagcatagtcagttcacttacgacaacgcggccgtcgccaaaatgtggaataacggctcagtcattcgcagctggttaatgggcttagctcaagatgcattcagcaaggatggtaatctagatgacatcaagggtgttatgcattcatccggtgaaggtcgctggaccttagacacggccctagaccaacaagtcgccaccccggtcattgcgatggccttgatgatgcgctaccgttcagaaaccgatgacacattcactggtaaagttgttgccgccctacgtaacgagtttggtggccacgctgtcgatcacgaataggaggaacgaagcaccatgacttaccttattggaactgatttaggaacgacaagtaccaaatccgtcttgtacgaccaccagggtcacgtaattgcgagtgccaacgttggctacccactctatcatgataccgtgaccacggccgaagaggacccgcaagaaatctggcaggcagtccaagcgaccatccatcaagtaagtgctggcattgatcccgaagacatcgaaggaatcgccttttcatccgcaatgcacagtttgatcctacttgacagtcagaaacagccgctgacccgggtcatcacttgggcagataaccgggccgcacaagacgccgctgaattgaaaagtcaacccctgggcgatcgcctatatcaccttacgggaacgccgattcacccgatgagtcccctggttaagcttcactggcttgcccatcattcaccggaattactagcacaaacctgtcacgtggtcggaattaaagaatacttgatttacaaaatgacgggccaacttcaaatggattattcaatggccaacgccactggcctattcaatctttataacttcgattgggaacctgtcgcgctcgactatgcacacatcacccgcacgcagctaccaccattggtcgataccgacgccgtgatcgatggactgacaccagtcgcagcatcaaccctgggactcgcacccacaacgaaaattatcatgggtgcaagtgacggtgccctttcaaacttgggggtgggggctgatgaaccaggagttgcggccattacgattggcacttccggtgctgtacgggtgatgacaaaacaaccatacttggatcctgaaggtcgactattttgttactacgtcgcgccgcaccactggattgttggtgggccgatcaataacggtggtcaagtcttccggtgggtccgcgatgagctcttcactactgaaagccaaaccgcccgtgcgaatcaacaagatccatacgaccaattgacagcgcttgccgcaaccgttcccgtcggtgcccacggactcttatttcacccctacttaagtggtgaacgcgcgcctctctggaatgcggatgcccgcggctcactgctgggcgtcaccacgaccacgaccaaagccgatattgcgcgtgcggtcttagagggtatcgtgatgaacctgaataccgtcctacaattgacggcagccgccgaaccagttcatgcgattcgggccactggtggctttgcccgttcaaatttatggcggcaaattttgactgacgtattgggacaacccattacgattccagcaagcttcgaaagttcctgtctagcagcggccgtgattggactcaaggcactggggcatattgatgatttaaccgcgattcacgccatgattggtgcaaccgaaacttatcaacccaacgccgccaaccaccagttatatcatcaacaccaagtcgtttttgaccacgtaacggcgcaattggcaccgttatatcacgaaattgctactctaaatcgttaggagtgtccactatgccatttgttgttcttacactcggcatcctactactattactattaattattaaattcaagctgaatacttatattgcactgattgttacggccgtcgtcgtcggaatcggactagggatgccattaactaagattgctactagtattcagaacgggattggcagtcaactgggtgagttagcactagtcttcggcttcggtgccatgctcggccgcttagtagccgatgctggtggtgcttacacgatttccacgacactattggatattttcgggcgcaaacggctacaaattgccatcgtagtcgcctcatttatcatcgggattgccctcttcttcgaagttgggatcgtcttgttgattccaatcgtctttgccattgcgatcgaagcacaagttcccgttctctatctggggattcccatgggcgccgcattatctgttactcacggattcttaccaccgcacccggcaccaactgcaattgcgacgacgctaaatgcgaacgtgggtcatgtgctactattcgggatcattattgcgattccaactgtttatatcgcaggcccgctcttttcacgctgggcgcaaaagatggttcctgacgcattcaccggtaaaccacacctgccacttagcagtaacaaacgtcaattcaaagtatctgaagcacccgggtttggactcagtgtcttaacggcgctcttccccgtgattctgatgacaatcaccaccgtctacgaattagtcgttgatcacggtgtgacacctaaaaacccgtcgacccttgaccaaatcattcgtttgattggggcacccggaattgccatgttaatttcactattattcgccctctggtcaatggggattcaccaacacaagaccaataaggccatcacggccaccatcgaagatgccactaagtcaattgccatgttattactaatcatcggtgggggtggcgccttcaaacagatcttaattgatgggggtgttggtaaggccgtggcccagttgttcagtggcagcagcatctcaccactgattcttggctggctagtcgctgtcatcttacgggtctcactcggctccgctaccgtagcggccctcacggcagccggcctagttgcgccgttaatgacgcaagctggtatcgaccccgccctgatggtaattgccatcggctctgggagtgtcgccgcttctcacgtgaacgacgctggtttctggatgttccgggaatacttcgacctgaccgtcaagcaaacgctgcttacatggacgatgttagaaacgatcatcgctgtctgcggtctcggaggcgtgttggcgctcaacgccatcttccattaagccctttgaactggctgaatgctaactataatccgcatcgaaccagtccatggtcatttaggcgtgacttactaataactgttaattaaaacaccgctgttacgcagcttgaagttgcgggtaacggcggtgttttgtgactgataaatcatctagcttagtggttaatccttggattgcatccctaaatcgtgcttgatacgcgtcgatgagatgccttcagtacggggcaaatagaccacctcgcagtagtcttttagaaaatcaaacttgccgcgccaatcgtcacccatcacgaaaatatcaatatcgttatcaacgacatcccggattttttgatcccagcttttctcaggtaacacttcatcgacatagcgaatggcttgcaaaatatacttacgatcctcatacgaggtgtacgcatgcttacccttcttagcattgaattcgtcggtcgagacgcaaacggtcaaatgatcgcccaaggcccgtgcacgcttaagcaaccgaatatggcctttatgcaacaaatcgaatgtcccatacgtaattactttcttcaaaaaatcactccttatgccacgttcaagcttaattcaccaattatagcacagactacttttttgatttagtggtcgtcgtcaagtctgctttagtcgccttagcaggttgcggctgatagaccgtcgtttgcttgcgcaagtgctcctcatttcgtaactcgacaatattatagaggtaaataaccacggtccggaccacagcatagaacggaatcgctaaaatcatgccaagaattccggcaatatttcccgctgctagtaataaaataatgatcgttaacgggtggattttgagtgtccgaccaataatgttgggatagattaagtttccatcaacctgttgaacaatcacgactacgataatcacgtacactacctgcatcggtgacttggtgaaggccacgatgagtgatggcgcgatcccaatgtaaggtcctacgtacggaataatgttcgtcaatccagcaatcacgccaagcaataacccgtatggttgcgagatcaacatgtagccaatcgccgtaaacgtccccacgaagagacactcaataacctgaccactgatataactagaaatcgtgtcgcccatcttttgtagtaaaccaatgacttcaggccgctgtttcttcggtaagaaccgactgatagctggaatgaatttctcactatccttcaacatatagaacaatacgactggaatcgtaattgccatgatcgtcacactcgtaatcgtggaaatcaccgtaacaacactacttgataatgatgacaaaaagttctgagaatacttactgatttcaccattgaattgcttggtgtacgagctaatgtcaattcttttcagtaccgaactattattgatcagcttagtagcggctttttgcatctcagtggcaatacttggtaggttataaatcagttgtgtcacctgacttactaaccgtggcaatagggaaaccgctccccacaccagtaacccgaataatagcacaaatacgatagccacagctccggttcgagaaatccgaaacttcttgtaatgaaccttagtcaacaacttgaccaagggattcaacatataaaataaaaatcctgaaatcaaaattggcatgaacacgacacttaaaaacgtgccgattggctgaaacaaaaaaccaatgttcgtgcagacccagatcaaggtcgccacaatcaaaatttcaagtgaccaaaataacaaggccgaatcttttaggcgcttaaacactcgcgctcctccctttcttggtgcaactattaatgcgttaattataccctatttcacttagtccgaatacgatttcgatatttctcacaaaatctatttaaaatcaatgagaataatggtaatttaattaatgaacgataaactttcaaaggagcgctacattatgtcacgtaaaattgccattatcggaatgggacacgtcggttcaaccgccgctcactacatcgtcgccaatggctttgccgatgaccttgtcctcatcgatacgaacaccagcaaagttgaagcagacgcgcttgattttcaggatgcaatgcctaatttaccttatcacacgaatatcattatcaatgactatagcagcctcattgatgccgatgtcattatctcagctatcgggaatattaagttacaagattcaccaactaatgaccgcttcctagaattaccctttaccagcacacaagtcaaagacgtcgctgctaaaatcaaagccagtggtttcaacggaattctagtcgtcattactaatcccgtggacgtcatcacatcgatctaccaagcggttaccgggttgccaaagaatcatgtgatcgggacggggacactactggactctgcacgaatgaaacgagcggtcgccagtgcactacacctggattcacggtccgtggccggctacaacctgggtgaacacggcaattcccaatttacagcttggtcaacggtacgcgtgttaggtcaaccaattaccaaattagccgctgaccgcggtttagatttgaccaaactagacgccgaatcacgcgacggtggcttccgggtcttccatggcaaaaaatatacaagttatggcgtggcaacggccgcggtgcgcttagccaacacggtcttgaatgacgccctcaccgaactccccgtttcaaatttccgggaagaatacggcgtatacctttcatatccagccgtcgttggtcgtgacgggatcgtcgaacaagttcaattggatctcacggacgaagaattgaaaaaattacaagtttcagctgattatatcaagaccaagtacgctgaaagtcagaccgactaatcagcactcaaacgtcaacgaactaacaatcattatgctaaccggttaatacgtatacaacgtattaaccggtttttatttatttactctgtcaaaacaacgttaacttaaaaaacaccgtatcttgccaaaccatgttaggaagtttaacgccgattcgaaaaaccgtgcaattgtcggattaccgttttatattaatgagcagctaaaagggggaattaatttgacgttcaaaaaaaggttatccgcaaccaccatgctgaccttgatcagcttcagtagtctggcacttgctcaaccggccaccgccacaactagaccagttgacggtcgtctacgtaccagccacggagtcacaatctatccgcaattgccaactaatcaacaccaattacggcgcggctacttcacccgccaacccataaacacggctttcaaaatcactcagcagcatcgtggccttggtggattttactttcacatcatcggcaatcgttttaatggttgggtcgccgcacgcacagtaataccgctcattaagcatttgacaagacaacaatttaaaacacccgtcaaccgggcagcaaaattgagtatctacaccacgacgctgccatttttaaccaaccggcagctgcaactgatcatgactcatcaattaagtacgcgtcaaatgaatcaacttcatctacgtgtgggcaagcccatccggacaactcgtgggcaatacattcaaatcctaggaccacagggtcggcatatccgggtttcagtcaacaagatgccattaagattcacgctgcctacttcgcaccaaagtcaacatttaatcactccaaccaaaacagttatgccccttcacgccaagactgggaacactttaacaacgtccaagtcaggcacgactactacgggacagtcccagaatcctaacaacactgttaaatttcgacacgccgagaacaacccagcactagcgcaccccaacagcccagccggacatccccaacatgtgaatgcaccaacaccagttacaccaccgaaccagaaatccacttcaacgctccagggaaaccattttatgggaacgccagtcaaatcatcagcccagtcgaacgaccatcacaccattcaacgaccagtgatagtccaaccacatgcgacgattcggttacattcaagtgctgccacggcaccgacccatcaagctccagtcagttcggtagctactccggctaatgccgcttcctcagccaccacaactcaaccggcaaccacagcggggacggtgcttaggcatcagcagatccacactaaccagattgcaaccgctacgcgaccagcaagtcaacctagtaccagcataagccctgtaagtcaggtgccaattaggaccagtgcaaacagcacgtcaacacaagttagtcaggccacttccacacaaactgaccacaaaactgtgacatcagcggctacaacacaatcggtcgccgtgacatcaagtaaaccgactgcaactggaacgtctgttgttagtcagaacagtgccacacaacctgccaggcacaccacaacgtcggcggtcacaccagagacagtcgtaaccccgacatcaagcgcagcgactttaaccgcaacatcgagcacgtcgactgtaacgggcgcccccggtacgacgccagtcaataccgcacccgtcacgaaatacacggctcagcaagcattacaagccatcaatcagctcatgaccactaatcatttcatgggcaccctactcctgactaacaatggaccagcgggagtcaaaactttgactttgggctcagctgatttgaatcagcacctagccaataccgttgacgagtcgtacccactagcctcactagaaaaatcagtgactggtgcaattattcagcatttgatcaatgcaggaaaactgacaatgaacacaactttagctcacttttacccgcaagtaccctatgcacagtcgattacgattcgccaattactcgaccacacttcggggattcagatgggcgaacctgtcccagatcaggccttgagcactgatcaacaagccatcgacttcacattgcaacatttgacgtctactaaccaacaccagtggtcgtattccaacgccaacttcaccctcttagcaggtatcgttgaccaattaacgggccaatcgtttagtgccaacctcgaagctgatattttgcaaccactcaacatgcagcacacgttcgtttataaccaaataccagccaccgctgttcatccgctcccatacaccttcagtaaaggggcctcaactccccggtcaatttcgactaacttactgtcaagcgagcttggttgtggcaacctctatgccagtgtgggtgacttttacaccttcattcataatctggtcgatggtcatctgctcacttcggctggattccgagaactggccgccaacttacaacccacctattctggcggaatctactaccgtgacgatgggacaattcgcattggtggtgccgacaacagtttatatagcctctatatcggctccaacgacagcaaaattgccatggtcttctttgccaaccaggcaaaatgggcgaccatgaacacagtcggcgttcaaattgagaaaatcttagcacaatccgcactattataggtactacgacttgcaaaaaaaggcaccaccgacatgactatgttggtggtgcctttagcttattggactaagcgaaccttgactggcacgattagttctttgttattatttaactaaattccatgtcatgatgattcgttttggctaattgactgacaatctgcaaccagtctttcatactaaccattaccgctgaatcttgggtgctgggattttccacctcaatggtatcgtggccttgattaacaatcgttaacaactggttgatattcttttttgctaatgcggtagtaacttttttcatacgcccatctcccaatccgttccataattgttgccattgtgcaccattcattcaaacccgtcaagcgctgctagcaattattcaagtaactgagcaatattttacactaagcaggtcccagttgcacctaaaagaaccgagttttacttaaaattaaagtcgcggggtcttgaacatcgacttcaagacgtttctgataattttcatctgttcattagtaatcggctgaccgtcgtattcaaattggtttttcttgttttcaatcacttttttaagatcaacagcagcggcattgatcgccttagctgtcggttctttatccttaccaaccaatttggtataactcgtaccgagcacttgagcaacttccttaagcgtaccgactgacggcgtgtgctttttccaactatagatggcactcgcacttaagcctgctaaggtcgccacttccgctaaggtcagtccattcttcttggcaaattgccgaatattcttaagtaattcaccgttatcaatcttcaaaaaagccaagttcgtcactcctatcggtcaagatctaatcaattattgttaatccactcaagctgttgacattacttaatcgaaccgcaactcatttgcaacaactttgttacaatgagcgcttatgatggggtcagcgttattgaatgagatggacatggggattttcggggaggaaatacatatgaaacaacgtcttatcacactgattgttgctattttaggcctcacggtggggctttggcaagcaccaaacgtcgatgccagctcaacgaatcgcgtcattaaaaccactaatcttactaaaagcgcctacctgacgaagaatactcagggcggcttctataacatgagtggtgccgcaaataatcttaaaatccagagtcggggaacgcttcgacaatatggtaataccacttggtttgtcacccaacaacggcaaattcgcttagctaataataccacggctaattattattttataacgagtgctaatacccgtgttcgtggctgggtcaagaccggctccctcaagaagagcaccagatctttcaccaacctctataacgtggccaaatccaaacttggccatcgctatgtctatggtgcggtcggtccgaacacgttcgactgttccggttacactaagtatgtcttccagcaagctgcgcagaaaaccttaccacgtgtggcccaagctcagtaccgacaatatcccaaaatttccaaacagcgcgcccaaaaaggcgatttagtcttctttggtagtggcacaggttcgatatcacacgtcggtatttatgttggtggtggaaagatgattgacgctcaggacaatggtgtcaaaaatgaaaaagtctacgttccatggtggcacgcggttggctattcgcggccagtcaactttggcgcttaaaagtgtaattcctattttcacccgacccacagaggcgacttgtgggtcgttttttattgtcctaattatcatgacttgtgtcaaccatgacggctggtaatcacctcttattattcaatgtcgagacgcaaccagaacacaaaagggagcaccccagcacggagtcactccctttgtactttaattacgccgctgacagaccgtcagcagagctattgccgacgtgataattcttgatagcgactataccagatatcaatgtagtcttgtgaaaacgggccttttttgtttttgatccaatcaactaagactttcacatttgcttttaaaatgcgatcagtatcagccgaataacgccattgggcaccgtgttcttcgtactcatcaacatccaacaaccgccgctcaccatcgggaaagactttgacatccaaatcatagtcgatgtacttcaaagcctctttatctaacacgtatggtgatgctaagttgcaatagtatgaaacgccgttatcgcgaatcatcgccacgatattaaaccaataatgcttatgaaaataaacgattgcaggttcccgcgtcacccaccggcgaccatcatcctcggtgactagtgtgtgatcgttacaaccaattagtacgttctcgcttgttttgagtaccattgtatcgcgccaagttcgatgtaaacttccgtcgtgcttatagcttttgatcgtaatgaagtcgccttccttaggtcccttagcctcgcgcgccatattaacccaactttctaaaatgagggtaaattttcatcgaatttcattaaacattataccagatttttatggcgtgcgggcaggtaattcaaccttttcattcatcagcaacttgttcgtcgataaatcgattgatatcgtccatcatgaagcccttttggaacaggctgcgtttcgtgcgcatcatgcgttcacgaaacgcatacttgcgattgcgttgccacaactttgccccctgtgcaacgagggcttcccactgttcatcttcgtcgggttctaatgccaaactcgcaatcgcggccgtaatcgtgtcattatcaaagcccttcgtcatcataccttggcgaactttctgttgcatggtcttaaaagcttggcggtgataccgttttgccagtttacgcgcaagttcactagcattatcgatctgctcttcagcactaaactgcccggccagcgcgtcatcaatcagctgctcgcccacacccttttgtcgtaagttctgccgaatcacccgtggccccttgtcactggtccgtttggccgtccgcacaaaggcatccgcatactgttggtcgttcaataaccgcaactcacgtaattgttgcatcgtcgcgtcgataaccgactcgtcaatttcttcatcccgtaacttgtcatgaacttctttttcggtacgcaactgatgtgagagataatccagcgcgcgcgtatacgccttggagacatcgtccgccgcaatcatcgctgcttgcagttgttcatcaacttccatgcccttaaaaacgcggaacttgatcatcaccgactcactgattggaaaagcgtactgctcgtctaaataaatgttataacgtccagctcgcttttgcgcgacaatcttcgtgaccttcttagtcaacgacaccaactcccatcatttaatctttactcctatagtttaccgaaaaatcgccgcgtcaaacaactaatttctccaggaagtgctaagatgccaaagtgctttaagacttggtcagtatacgactgcatcatctcgtgatccgtgtccgccattgaaggtaccgattgatcgggcactaatcgccggcgatgatgttcctggagcgccgcttgtaattgaccagccttcgcaagttggcgagtggccacgcgctcgctcatatccacttgaatcgtaatttgaccatcataaactaaggccgtcataaatccttgagcctcgatatgcttcaaataatgccgattgtaccagctggttgttccccgtttggccgtacttaacggcatcaggatcgcatcaccgtgaatcacaggtaacttgtgtttcgataaaccgagttcaccggcgagttgcttgatcaactgtgtcccagataaccccagacggccagcgtaattcatcatgatctggcgcgtcgtcagttttgtcttgatcaatccccgttgacgatcaaagattagcgtattttcaacacatgtcaggtgttttatgtcaagtagaaaaagtgtctccagcacgtcgattgtggcaagttctgagcgttgcgcgatgattaataatcgttgtggctgtcgggtgtcccaagtaccagcgtggcactgccaaaaagtgttaacgtgatgcggaacgtcaatattttggttcatagatggtaaatccccctcaaagtcggtatttatctctaacattcaccagccgagcccccgctgtccgcggttattttagattaatcacatcataacaattacgtacaatctaggaaagtagttggtctgtaatctatccaaatctcattggaacattaataatgaaaataaatcgtcacttttcagtccattttcacgacctgcgtcagttgcgatcgctcgctacactgatatcaaccttggccaaggaaatcgctcataaatggggttatttagatgcacgctgaccgttttgataatcaaatggctttcgatttactcgcccgacccgagcaccaacatttactatacggcgctttaaaagccgcccaagtcaccaaataccacccgcaattcgaagattgtgtaaccgtggcccacctgacttggctgtctgcttaccagaactacgcgcccgaattgcccgctaatttaccagattttcgtaaatttgcatttcgccgtatcaagtggcgaactgtcgactatctacgtaaacaaactttgcgcacccagtcgcaagtcaacttggaacacgcactgcccattaccattgatcccatgaccgaacaagagacccattggcaattaaccgccctcttaacagaactccttgtccaatgtcggccaggtgagcggatttatctcaccgaattctttttcgaggaacagaccgttagcagtatcatgcggcgccaccaggtcagccgccgaacagtctacaactggcgggccagtctgctcgtcaaggcccacaagctttaccagcaacaaaccaccaattaactaatgagactgtcgcagtctgaaaggaactcacgatgcatatttggatgaacacacatgtactgctcacagtaactgattctaatcaacgccagttccaccaacactggttagcagatcgcgaactgaccgacagcgactttactaccttgattaccattctgaccccactattcgctgagaagatcatcagtattaccgttcgaaccatcaccgagtttgcggattaaatgggggctagtcaaaaaagtttaggcaaaccttgcacaaatcgtcaggctcaaccgtctgtattaatgtaagctggccagcctaccaccacaaaattcaaggaggaactcatcatgactaaaacttggttaaaagcaaccctgactgttcaaacaactacggaattggacgaacaacgtaagcaaacctttaacgcaatcgcccaagacgcaactgacgaacaacttgccgcttttggcaagatcgtcgaagtcttgacgggcgaccagttcacggccgctaacttggccaacgcctaccgctacgatccacaacccatcgcttaacacgcccataataataggaggaagcgcccatgaaaactttagacttaagctttaagactagcacaaacaaggttcaccacttgaagttacactacgccaacgacaacttgagtaaagacgttgttagtaaggcaatggcggacctcgctgccaccaagctattcgtgaaggatggcgaaaacttagtcgccgaaccgcttgctgctaagtacgtcgaaaccatcgagacaccaatcgtcactgcaccaaaggcttaacctcgcgttacctgcaattacaagaatccccggtcagtaattgaccggggattctttggttatcatttaaagtcgtcttactcttggcaatcacttcagagctaaatatcacaagatagccgcatcgctttcgtctcttgacggtcgacagggtaaatctcgataataatactgttaccgaccggatgccaatcaatcgctttaaccagtgcccgcataaacgtccgcgtgatctgagtcttgatcgaaataccgctacgctcaatgtcatcatagaaaatgacccgttgatctagcttatcaaccttaaagtagtagtacgcataatgggccgtcccccgtttcaaaattaagtggtacgaattattataatccgcgggaaaaaccgtgatccaatcgtcattcatatcggacatccttttcacttgaatttgagctctaatctaattgtaccttgaacggtggtgaaaacctagagggaatgtgtgagaaatcacgcgagaaagccaccgtagcaacctaaaatttgccagcttactttcgaacgatgggccaatatcagcagccattgtaaccatagccacaaaaagattcattaatttggactatcttctacttaatgaccgtgataagaacgagctctttacgcttcattcagcttataacttattctaaccgtatgtcttaaattacgcgattgctaggttaacacatagttaatgcttagcaaatatttattcactaattggcagagtcatcactatcataccgtttttagtactataatcacctcaattattttttcatagattgattcactttcccctcatattttatcccggtcacaattattaggcctaaacccataactcattagaatacgtagctgatattttttctgttcattaactaattttacgacgcaccacttttactaacagttgcgcgcttttaagttgctaataattgcaactgggtgaaatgctggtaaattatagttaaccaaagttcaattagtcaaatctaaccctcaaagaattacagcttaaatattggtttattccagtacaatatttgctataatgagattagcaaggctgcaaagttaatcgtatcaagcatatttacttgatagctattttatactataatcattaggttgtatcaatatggttcatacatagtcagtttgtggtaacccgaacagtagtaatagattaacctggctgtgatttacgggggaaaatatttaaaggaagcatagggtgttacttatggaattgaaggaacgagaaatcagaccgattacgattgacgccgggcgtcagcatcgtcgttatggttatcggttcattaaacgcgtgtttgactttgttgctagcctcttaggcctcatcatcttatcaccactcttcttgctaattgcaattgcgattaaagttgaagatcctaaaggcgccgtcttctactcgcagacacggttaggtcgtggcgaagtcccattcaaaatgtataaatttcgctcgatggtttccaacgccgatgaattgttggaaaaattacttaaagataacgagattgatggtgccatgttcaaaatgcaggatgatccccgcgtaactaagattgggcgattcatccgtaagtatagcattgatgaactaccacaattgctaaacgtccttcaaggctcgatgagcttagttggaccccggccgccattgccacgggaagtcgaagaatattccgactatgacaaacaacggttagccgtcaagccaggttgtaccggtctatggcaagcaaccgttcgtaacagtgtcggttttgatgaaatggttaagttagacttaacttacatttctaaacggagtgtcgcatttgatgtctacattctgttcaagaccgtggtcattatgttcaagcctaatggcgcttattaaacataaaaaacaaaacgcgcaaccaaactcaagggggaatttggttgcgcgtttttgtaacccattgatttgaacacaccacgcaccattcgctcgccataccatcaaaatcatctcccctctcctgcaatcatcattgattccacgaccctaccggccaaattttcagtccttgatcataagtgcacacgaacacaactcactggggtgctccaagtattacgccagtctcccaatttaattatcgttgatataactatgtcactccgcagttaattaacaataaaaatactttctaatttataaaataataagtttgttaataaccaaccctagccagttaaaaccactatcaaccggctaattggctgtgatacaatgaattgaatgttgagaaattcgacgttagactgcttaactgccacaaggagccactcatgcgaatcataaggaattacttttatacagcggggtataacctcttaattttactaacgcccctcctaaccgtcccgtatatctcacgggtcttagggccgaccggcgtcggtatcaatgcaacgaccaattcgatcatcacttactttctattgttcggaacggtcggtattacaatttatggtaatcgcgaaattgcctttattcgcgataatcgggggcaacgctcacaaactttttgggaaattgaaatattacagttattgaccatcagttgtgcttatctcgcctttttagtttttcttttttttgagcaccaattgcaaatttattttttctatcaatcattttatattattgcgggtgctgttgatatttcttggtactttatgggtctcgaggatttcaagaaaaccgtgctccgtaacatgctcgtcaagattgcttctgtgattgcgattttcatattcgtgaagactcggcaagataccggaatctacattttgattttagcgggctcacaagttttgggcaatctgacactgtggccatacttacgacatagtgtcgaacggcccaactggcgtcaattgaatctctttcggcatctgcggccctcattagcattattcgtgccacaaatcgccacgacggtttaccttgccttgaataagaccatgttatggcaaatggattcgctaaccgccgccggattttatgattactccgacaagttgatcaagctcgttttagcgctcgtgacagcgactggaacagtcatgttaccccacattgccaacctcttcatgaagcaacaacttgaacgcgtcaaacaatacttatacatgtcctttgactttgtgctcgcgattgcgattccaatggctctcggcgtggcagcggtcgcaacgacgctcgcacccctattttttggacgggcattttgggcagtcgaccgactgttgatgattgaggcacccgtcatcatcctaattgggatgagcaacgtgcttggtcagcagtttctgctaccgactaagcagactaagacctatacgatttccgtcactatcggggccctcgtcaacatcgcttgcaacatcccacttatttggttttggggcgtggccggtgccatgtgcgccactttgatttcggaagtttgtgtcactggctaccaactattcatcactcgacatgttttgcatgcgcaatctctatttactggaatttggaaatacacacttgctggtggattaatgtttacatttgtatttcgcctaaacgtcaccatgacagcttcctacttaaacctttgtttacaaattggtgtaggtgtcttattgtatcttggactgatattactattacaaccgcctgtattacgcaacgctatcaaattacgcaacaatcttcattaacttcatatgtcgtctctatacatcaattacaaaggcccaacaaagttaaataagttattgggtctttgagattaaagtgccccataaattggagtaaatccaatttatggggcactttagggttgctttttagttgtttagtataattaactgttgctttaagtatctgagctgtttcattaatgtagccagttcgtgattacaatcaaaagcttgtagatttgcctgtatttgccgagcaactttcccaatagtttcttgaccagtagtagtcaatgacaaccaaactattcgtcgatcgctttgatcaatttgtggctgaatcaaattatcttgaatgagatgccaagtattcctagaaattagtgtgcgagtgaccttgaatacttttgctaactcactagcactagcttgttcatgttgctcaagatagactaatacttcccactcacgcatggaaatcccggttgttacaagtccttgtattgacatttggtgcacttgcttctgaatagattgtagtgtttctaaactttcaaactgggctttgatttgttgatgatttagcatatacttctgccctactctttgtgctgtcgcttagccataccaaggagacctaataggccactcatggctaataacaataaaccactaagcgtcatatgttgttgatccgtttcattagtttgtggtaatcgttgacccacaaacttaatggttattgtttgaaccgacttatcagatgtcatcggttgatctggttttgctggtgtcgttagctgtcctggtttaaccggttgtgtcgatgttgttggttgacctggtttaaccggttctgtcggtgttgttggttgacctggtttaaccggttctgtcggtgttgttggtatcgttggttgttctggtttaaccggttttgttgatgtgctatcagccttataaactaccgtaaattcaaggtcactggaatcaccagtaacggtctgcgtactaattttgctctgatctggtgtgtagcccttaattgctggactattcacggccgcaaattgttgcgctgccgaccaacccccatatgtcttttcacccgtgacagcatctgtagatacagtccgtgtaaacgtgatgggctgggccacataatcatcatgggctatagttccatccgtataaacataatgaatagtctcattgaccgttttactttccgttgtcacggttggagcattcttggtgtacacgatggtaaattcaaggtcactggaatcgccagtaaccgtctgcgtactaattttgctctgatctggtgtgtagcccttaattgctggactatccacggccgcaaattgttgcgctgccgaccaacccccatatgtcttttcacccgtgacagcatctgtagatacagtccgtgtaaacgtgatgggctgggccacataatcatcatgggctatagttccatccgtataaacataatgaatagtctcattgaccgttttactttccgttgtcacggttggagcattcttggtgtacacgatggtaaattcaaggtcactggaatcgccagtaaccgtctgcgtactaattttgctctgatctggtgtgtagcccttaattgctggactatccacggccgcaaattgttgcgctgccgaccaacccccatatgtcttttcacccgtgacagcatctgtaaatatagtccgtgtaaacgtgatgggctgggccacatagtcatcgtgggctgtagttccatccgtataaacataatgaatagtctcattgaccgttttactttccgttgtcacgattgggacattcttggtgtacacgacggtaaattcaaggtcaccagaatcaccagtaaccgtctgcgctgacacatgctgcaaatctgaattaggcgcatcagtacttgttactgtatagcccttgatttgtggatttgtaactgcatcgaaatcttgactattacccaatacccatccagaatcgactggtctaccagttgtcgcatctagttctatcgatgttgtaattgttgaatagtaggttgtcgtcgttccatccaccggattcgtcacggtcaatatatggatgggattggcggtgtagctagtggtcaacgcatgaccattttcatcaacataattaatagtttcgttaactgtcttgacaatagccatatattcaggcacatatacatagataacagtaccattgtcacccgattggattaaggttccattggcatctaaactttttgtgccggtaactgagccatcatccatcttaataaatctataattgggaattattaattgtttagtggtgtaccgaccattgacatacgctccatctggataattagctgttccttgagctagctgatgtccagtagtatcaacatattttacattcacagtcgctgcttcttgaaaatcgaagctagtcaacttaaattgttgtaaatttttagctgcaccagttgatgcactgacaaccatggccattgcttgataagaactggcaacagtcgtcttccaagttaatactttaccactagcttgcgtataactaacggttaacgttcttgtagcaccatcatagttaactacaaaatcatgaaagttaccatcaatatccgctttacttaacgcctgcgactctcctgtatcttgagcccaccatcgctgtaccttagaaccattcgcagtcgaaatttcttggttactcgtcttgacaaaggtgccatatggtgcgttggctgagtcaccattccaaccaaagccattagaatttgttgatgagatttcactcccatttttatctgatgatggtgcttggtagctattaaaccatgtgtctagcttgaacccgatagcgtcttgcaatccaccaatacctaaattaccaccagcatttcccacgtcagttgtattgccactgtgaaaagcaaacccaattccatccgcaccattcgggttagaccccagatttacctgaccagttaatgtaaagcttttattcatatcaatcttactggttaatgaaaaattaccaacttgattattttgattgggcgtaatagttacaattcccgtcttggcatcatatgttgcagatccgttcaaactaaaatactttaggaaattgtccttgtctacatgagtcaaggccgcttcatcagagatcaacgctttacttgtacgaagctgctgtaacaatgtgctatatgacacttttgtcttggtggagtactttttaacactagtcgaggtagcacgaaccgctttgcccgtagtcgtagttgttaacgattgggcttggcttttagtgctattaatcttccgactacttgtactggttgtctgactagtatttttcgcactactggattcttgattgcttgtacgggtcgcttgattaatactcttggcactgttagcttcttgattgcttgtactggttgtctgactagtatttttcgtactactggattcttgattgcttgtacgggtcgcttgattaatactcttggcactgttagcttcttgattgcttgtactggttgcctgactagtatttttcgcactactggattcttgtttgcttgtactggttgcctgactagtattttgaacgctactattttcttggctagttgcgctgaccgccttattgacaacactcgcgctagcgtcttgattaattgatgcactaacacttttatcatcatttgtaagaatcacattactagacgtatgctgatttttagacgcatcagtagagatgctcgtcacatgttgagatgctgaatcgttcgtcacttcggaatctgctgcggcggcccgtgtcatagtaacagtacctacccccaatgaaaccaacgtaatccccataatagcccagttttttccacatttataaagcttatagtgtgttttatgctctccaaaattatccttttttaacataaaaatctatcctttcgcacgattttgtaaaaaatcatgcgaaaggataggtgtaaaatgggacattataattaaagtttctcagttaaattcacgataagtatagcattacctatttgataacgcagaatatatagcacgattttttacaaaagcatgctaaagttaccttgttgccttaattaatcataatggtaacatctttctactacaaaataaattacatttaataatttttgtgttgtccatgaatgatttgtattgcaaaatatcaaatttaataattatgatggaaggtctctaattatgaacattgcacgctttactcccttgcgtatctcatcatccgagcaagaattcattttaaatttttcattattggaacatgatctgatacacttttttaaaatacgtgatttcgatcacgcaattagtcgcatcaataaattcaaggaagttcatcctataaattggatcgatgcagaaatacttaatcaacttctactgggcttaattggtagcttaacagcagctagttatacccacaatctcaacctaaatgacttcctaaaattgcgattatatttctttaattttattaaaaaatcaccttgtacatcatcgacattttggccattaagcaatgatatcattactacttatttcaatttattagacaacttcgactttcatgtttcttaccagaatctatcaaaacaagtggctttaacggcttattacatcagtgcccatccacaagaacttactaacagtcatggagttctgcatactttaaacttgaacaatgattacacccaaaaactgttcaaaaaagaactaggattttcaattaatgcgtatattcagcatattaaattatcagaagccaagcgtttgttactacaacgtcagctatctgtcggtaaaatcgcatctttattgcacttttatgacacccctacgttctcaaaaacattcaaaaaggctgtaggtttgtcaccactcaagtatcgcgaactaaactatctgtcgttaacaagtcagtcctattaatatgacctggtcactattaaacgcgtactggtggttatcgatacacgttacttgatgttcatggtacaccaggatcacctactcaacacttcaatttgtctgcattaaattgaaatgtcaaacgttaaaaatgagtccgtttagcagcttgtgggaagaacttacgtttcaacagattatacgctttcgccggtaactgttgcttttccatgtacattaccgggacttccacgtacttaagttggttatggttgatccacacgtccaataggaactcagataagtacccgaaaacgcgagcttcttggacatcgtaatccgcaatatcgatccggtcacgcacagcaaacagaatatcaaagacccatttggcatagtcgtcaaacttaggacccgccataatcatcatgttaaacatgtgcgccgacgtttgatgcatcaactgatcaaaatcatctaagtaggcggcatgacgttcactaataaccgttcgcatcatgtccagtggttcccgatgatgtgcgtgaacgtaatgtgaataattcgattcaatataataatggcgcttttttggtacgatgacatcatattgctgcaataaactttcaatttcggtcattgataaaataccggctaatttgcgtttgggtgcttcagacaagtagcgtcgatattgattcaagcccttaacatccgcatgacagttcttccaaatccagtacatcgctgttagctcgttaaagttcgggttgcttgccgaaatgttatcaccgacgtcatcaggttgataattttgtggtgcacctccatggatcgcagcaccaacaaaaataggtcggtaagttggatcctgtggcatttgatacggcttatgagccgctacataaatttgtactttcatttgccagtccccctctggtatgaaatttgtgcctcaaatcatgataaattttccatcatttaataatgcaagtatttgcacgtgactgttaggtcaattaatcatctcggtatttgccggattatacacagtaatttaacgacgttgtagccggcgaaatagatactgccgaggtaaaaaacaagctcgaattcccggaagatgcggaattgccagcatggcaaccgtcacgaagccaattcggtaactgattgcgatgatcgtcgtcacgagtggtcccatatgggtaatcaaatgattcgtcaaccatccttcaatgccaatcacgtttagatcgatcaaatgaaaacacagaaccactagcgataactgaccgtagcgttttaaccacttaattggccgcgcattcggataatgactaagccagtcactgacgcgaatgatacacaaactgccagcaacgccccccatgacgctaatcaacagattaggcgatgttggaactgtcaacgcaaaataaccctggaaagcactcactaaccacatgaacgtgaataataaataccaagctgatgatatccgacttagcagggctgtttgattaacgaggtagccagcatataaaaagagctgtgctaacaacgcggcgttaacggcccacggtaaataagcgacttgaccgagccaaccacctaagattgcgaaaatagcgaacaccccgccccgtacaatggcctgacgccagcgctgatgacgtcgggctgttagtagcatcacaccattgaacagttgcagcgcaataaacatactgagcaagaaccacacggccccaatcggttgaacttgccagtgccacggattgaacactgccgaaccggccccgtatgccgtggcaattagtccttgtcgccagcttggaaaatacgcattaaggagcggattcggtaataatcgggctatcgcacttacgactaagagcacaactgccgttgcgagatacggtagtaataggttaatgatgccacgctgacattcttgtcgtgccgggcgtgagtgatacaaataaccgctcaacatgaagaaaatcggcatgtgaaaggcgaagatcaaactaccgaagaattgcccgttataggggcccaaggtatgaccaaccacgaccgctaaaattgcgattccctttgcaatatcgatccactcaattcttttgcgcattaactgagcctcctattaactgggagccaccaaataaatctggtaatatccgttgcaaccagcggacatgtcgtaataaccatactagttcaacactaacgatcagcaccgcgatactccagagccaaccagaccaccacgcgccaataattggtgtcagcaaccgattaatgaccataaatggtgtaatcagtagaccggccaccagcatatcaccataacccgtttgaacaaagttatgccggcgtactgctttggaccgtggccggttcatcatccaggtggcaatcgtcacccacagcgtcaaacatggaattgcctgaaaggtttgggcaaatggctggctgctgataaggtcaaaattcttttccagattcacttgatacatcgtgaccgacaccatcacggcatagcacccacatgtcagcagccacgccactaagaggtgttctcgcgtaatccggtgtaacacctccgtttggctcaaccaataccccatcaatgcaaaaaagcaaccggccgtaatcgcgagcggcggattaacactgatcgtcgtcaagccagtgaaataggccaagattggtaccatgccaataaatacgagctccgcccaaaataggtattgctgaatcgcaacactcgcatggtgtgcaatcacccttaacaacggcaaggtgacaaagaagcccaatagttcatataaaatgtcataaaagcccacgggcgcttgggctaacgcggttaaaaagccggcaatgttaaaactagttaaactgccttgggtcaccaagtcttcaagatagaaggccagtgagaataaggtaattccgcctattatccataagactcggcgaatcaactgtggcacggtcaatgccgtgcgccgcaattgataggcgcccagggccatcaacaataagttggggcccgctgccgttattaatgcaatgacgagctgcggatagaaccagatactttgtggttggtggctaaaactaaataccgcgttcatcccggtatcaccgaatagaattaacatcagggcgatgatcaggatcaaccgctggacccgataagcctgttgatgattcatcggcacgacgccccccttcgaataacgacaggttggtcaaatgcggggccgactgccgtttgataatttggtaaatcagcgaataacatcagaataaagacgttatacgttacttctaagaagtgctgatcaaacatactactgatggcaatggccacaaagattaccggcaacaaataatcgtgttgccgcgtacgttgatacaaaaaccaggtcataccgataattataatcagcgttaatagtaatccgtatgaaatcaacatatttaagaatgacgagtcaatgaagaaatacgttgcatcaccaacaccattggtaaacgtttcaaaccgatcgccgccccaaccattaattggaatcggggcttggccgaataatttaacgccatatgctaataacgcgttattccctagcgcgagtcgcgtggacaaggtattattgagcgctaccagcaaccggtcttgataattaaaaatattcgacaacccaataattagcccactagcaagtggtaacatcaaaaagctataccgaatcatcggccgaagccaccgaagctgacggcgatagatatagaccaagtacaagctgatcaaaacgagtaaagcaatcacatccgtcatcgttttcgtaaactggtaaatcattgccaggccaaacaacacgggtaatagcgctactaatcgaaaacgacgggccaataaatacaaatacgccgcacacagatagaaaatatgggccgcaaaatcagtggtatacacgacaccaaacgactgacgtaacccatcggcagttgcaaacgtaatatttttaatcagtccgacttccgaagcaactagcgctaacaagagaatcgtccccacgacgcccagataaacttgaatgatctgccgaaacgaaacttcccgggccgcaatcaccaacatgattgtcggcatcaaataatgcgcacccgatgtgagcgtcacaacagtcaccagtacaagtaaactgacttctccaataatttggccgggggtcaaggtatctaagcaaaccacgaggcccagtaatgcggccaaagtcgctaattcaagcaaaacgcccactcgatgcggtatcatctcgttaaaggtcgtcgtctgtagtgtgactgaggctaagtagattccgaagataatcagatagagcacattacggtgctgctgcatacttgctcccctacgtctcatcatcgtgccgcccccaaccctgaccatatttcacgaggtacggactcagcaacgccaagccgcccccaacaactaatattaacttccaaagcgccccgcgaatcacgttcgtctcacgcgttacggtacgtttaactgtcttcactcgataattttttaagcccgtcagattagctttaatcgccacattgaacgcctgagcattctgctgggccacttgccgtgaactactcgttgctgtcacccgtaagaccggtcgccgcgcaactggtgccgcttggaccgactcactcagttcctgaatcggttgccaaatgccataatgcgcataggcataagtgctggctcgagtcagcactgcactctggtgtggcatcacgttgaactgcgtgatagctttgatatcctggcgtcgctgacgttttagacgggctgttgacagccctgaacgcggcgtttgcgcaatctgaatatcaacagatgcttgatacaccggcttaggtagccaccgattgcctgcccatccaaggccgacgcttagcataatgatcagcaattcgagcggcaaccaccgccacgctagactaaagcgttcctttggctgtaccttcatgtgcctcactcactcccacgtagactaatttgaaattggctccagagataatcagtgaccaataaatgctgctgccccactgctttaaatcgccgatcaagtaaccgataacgtggctgtttctgaaccttttcagctgtcgtcaagtcaaatattaaccggtagcgatgcttggtggtcggtatcaaattcaccgcggtcactcgttgtgactgcgcatgatttagtttaacgcgaccaactaacctgaccggacgcgtcaaacgattggcacgataaatggccaactgcgtaccgcgctgacgaaacaggtataagtgttgatcaatcaagctcattccagcgacttggcgcgctgggagctttcctagttgtaacgcgtgccaagctttgacccgtccagtcttcgtgagctgtccataatagagtttggcgcgactgctttggcgatcaatgccgcgaaccacgacaaccgctgaacgagtcgtacctggaaagacggcctgaacccgaccttgcttaaaatcagccccgttaaagttcaaccgttgatgttgccaatctttaaaattagtcgtccagtaacggtcttgcccatctatcaacgtcaaacggccattcgcgtaccagacactcggccgtgacaattgcacatgcggataactaattggtagtttcgtccatatccggccgtcttggctggtactgatacgaccgtacgttgtcgcatcaccacgctgctgtcgattttgaaagaccggcgtggcggtattctgagtacccgcctgtaaataccgtgcttgacgtagcgtcttgcgtagctccgccgtcgtctgtgcagaacgatactttagatgcactgtttgattacggcgcggcaacaaagtcgacaatggatcgcaattcgttaagacatagccattaatgccagattgaaataaattgcggtgattgaccttacctactaaggtaattggtccgggtgaaataatcggcgtcccattttgatcagtttgataaatccgcgtgaccgtgtcttgacgctacctcatactttgtcgtcataaaaagatcctccattatttaacttttatcgtgaattatatcaaatagttcacgataaaagtacccactcgacgccctggttatgcgcttttcatccattttttgttcgtaaaattgctatcgtaattttggtaaatcattttattaatattccgtactttaataaaatacatgggctagtgtttcaccagctattcagccgtttcaaacacgcgcacgcgtaatttatcccacgatttgtaagtattaatacgttttaaacgtatatcacaagatacatattcaaataattctcaaactcttcatccaatttaaaagctaggtttctactcaactaggtgtatgtaaaattattttttgaatattagtaaatttaaatatttatccttgttaaatttactgattacagtcaacattcacatctgaaaacacaaaaaaagaacgtgagatcctcacgttctttacaccttacctttacgtaattgggttacttttttcagaatgtccggttgtaagattaaaattacaccaacataaaataatatgccttcaataatctgcccggctagactaaaggttgaaattttcatatttacattcaataagtacacgggaataaacatacaaatcccagcaacaccgtacttcaacgaattactaaacagtcgtctcatatggagagccttacgtacccgaatcaattgatatagcgtcactgccaactcggaaagtaacgttgccaccatcgcaccgtaaacaccccacgcaagaattaacggaacattgacgattatgttagtcaccgcacccagaacaaccgacaccgtataagtaaatgtctgcttggttggcagtaaaaactgttgtccaattacattgcttaggccaatcaaaacaatgacgggggcctcgatcatcaacagcttattgactaacgagaactgctgaccaaaaaaccatggtgctaaggccgtagctagcgctgcaattcccaatgccattggaattgaaattgataatacaaaatcaaatgaagtgtataggtactccttaacttgcttcatttttttgttggcatagaggttggcaatgtgtggtaacatcaccgtcccagtcgaagttactactgccagtacaatttttactaatttgtcagaataatcataatatcccgaagcagtaaccgaatctaacttccataacattgttttattaactgctaaatagattgtagtagcgacttgtgggacaaacagcgccaatgatggtcgcaaatgcttaaagatatgcatttgcttaaactttggtgcatcaaccattttaggtaagtacggccagagggtcatatttcctagtagttgggacaccgacagaatcagaatatagattccgacatcattatgtgttttaacaaaggtaaagatagcaactagtgacaacaacttcaccagcatatttcgcaatactgttttcttaaaatcctcgaggcccataaaaaaccatgagatatcaaaagctccggcaataatataaaacgattggtagaagaaatagattctcaactctttttgaagatataggaagatacaaaacccaatgtacgcaattgcaatcgtggttaactgcaaacactcaatctcccaaaaagttttagatctttttttccgattatcacggataaacgcaatctcacggttgccataaatcgttatcccaaccgtacctgcaagcaaaaaatatgtaatgaccgaattggtcgtcgcattaatacctacccctgttggacctaacacccgtgagatgtacggtacagtcaacagcggcgtcagtaggatcaagatattatagcctacgttatataaatagttcttaataagtttcatacgtttcctcacagtgacaatttgattcaaaatagttcgcacgagcgttaattatatcataatttccagttcgaccaatgtgataaaagaatgtttcaccaacttacaatcttcatgataaaagaaaatgcacgaaatgataatggaactcaattcatacattgactagccgattccatgcacaattttctgtacgaaggatccgaattatactttttttatcttgggagtaaagaacagtcctacaaacattccctttagaatagttttaattctaaagaacttattatccttacttgcaattaatacttgaattattgtcttaatatccttaagaaagatctttacggtcttaactcgactactatacattcgagaaaccgccaagttattcctaattccgtaaaagtacctattcatccgattcttgtcatcattaacaatagttacgtctgagattttgataggtgtcttgtggtacacgacactatccaacactaaatatgatggggattcatttgataatctcgttgtatattcagtatcatcaccccagataaccatgtcagcagcagggattccaactttagccacggaagtacgtttgaagaaaacagatacaaaagttgcacgttcaacctctaaaatctgatcattcaatttactgtaccacttattcgcttttagaataggaacatttacgacactgtcatctttccataaaactttgctacataaaaagccaaaatgattgtgtaaattatccgcataggtttgtagactcgataacgcctctttattgggcattgtatcatcatccataagccagaaataattatcattcgtccgaatatacccttgccgaaccgcttcactaaaaccaccagcaccccccaagtttttaggggagttaataataattagctgatctgattcagacatttttgctaaccattcacgcgtaccatctgtactattattgttaaaaatcaaaatatgattaattttcgtggtttgatttaatagtttatcaatacattcttttagcaattcaatacgattatacgtaactataattgcgcatgtagatttactgttcattattttcctctccaaaacgtcctaatatacacaccacaacagacatcttattataataaattaaagatatcttgatatggtaccgttccgtaagtattttgaattaatacaaagcggataaaaaataaaactaatattactgaaatagcactatatacgaggtgtcgaattcttgcatctttaatgaccgatcccaaatttggaacaagtgtaatatatatagggataaaaaggaataatagtctagatggcgtcggtaatttagcaatcatagccaccactaaacaagcacaataatgaagattaatctcagtattgaacttatagaattcagctttgggtacttgtaaatacacaaagcacacaaagcacatcatcattattacaacaagtgccaataacttactgaaacttccattatcaaattgaccaccaaagtattcggaataaagccccaatttatccgaaataaaaattatcccttgcctaatatatcccgacaataagaatacaaaaatcatcgtcagagtcatatagaacggattaattttaatctttttgaaaatatagaagaaaacaaacaatatgcaagccgaatggaataatgttgcgattccaataaagactaaaaataaaattggccgcttctccttgatatatttaagcgcatataatactattgctacaccaatggattgtcgcataccgctaagagaaaaagtaaaaaatccacccatcatgaagatcaaaatacttagataaacatttgtggattggtcttttatgtacttaaatacaaaaaagacgattaaaaagttagtaattgcaaaaatatactggtatgtccgaccttgtccaagccaataaccagcccagattacaactttatacaaaagttctacttttacgacttggtgtcctaatactgctggtatttgataacttgaatacgttgtataatcaattccgacgttgtatctaatcatacctggaatacatataataaggaacgacagtgtgaaaaataagtatttttctattttagccgtcatattattttcaattccatccacaatacgaattttttctatagacgtatatagaaatgcaaaaaacattgagaaaatggtcatgtagatatatatcatacttacccctcctttttgatacacaattcactatagaccataaaatgttttatcggttaaatttcaaaattactttttgctgaaaattttttactcaacatttgatttaacttacttcctattattttagaattttcttcattgagctcgacatcatttaaacagattaccttatatttcgcatgaaataatgatttttctattctatcaatttcattaacttcgaggaaggttccaaagtccaccctttggggttcaaacatgccgctctcaacattccagtacttaattaaccattgattaatttcattttctgggatcctaaaattatcaacaaaggttttttcaaacattgctggttctatttttaccaggtgttgaaatgtactttttaaatgggatgctggaagatgactattataatacccagtcacccgtttccatggaaatagaagtagactcttaaataaatatttaccatagccaaatgacaagaattttcttgacgtaattattcgacttctatttttaacaaagtatttatttattaccgcgatatcattaaccaaaatatgatcaaaactttcttttggtgtcaaagcatcatacaatccaaattcttttggtagcccatttttaaaaaagtcattttttttcgtaacatgatttaccaatgtatcatcattaaacagcacaaaatgttccgataactccttaattctaaataaatttaactctataacgtttgaattaaaggttggtagatacttacctggtataaaatcctcatggaaaatcactttgattttgggattatttacatccagccagtctggaacctgatgatctgtaataaagaacactttgttaatccatggacagtatttgtcaattgagcgaaagaaaaatttgattgtcccaaaatctcgatacctttcatcatgcaattgaatttgcttctgggcagctagtttatctcttttagttttccattgaatatcatcatcattgacccaagtaacaacgatatcaactggatattcttcttcagtcatttttttgctccactaattacttaattgtccgtcgattttttgatccactaattactttttttacaaacatataaaggtttatgattaaaaatagtcgccgatactccaacaaatacaataccttttggtgtaacgctaagttaaacgtttttggattatatataaaattagcttttatatcttcgttatccataaacccaatgaattctttgcgccttgatgaaaaagattgagtattatcttcattacagaagtctacatttaataactctgttactagatcaaacacatataatgagaatggatccatgtatctgtgactttttgtcaattgaaccgcttgtttcatttttgaaattaataatccatgattttttttagccattggatcaaatccattagaaacagatgtcacgctggaaattcggtaatggtaaacgccatcctttgcatccattccataaaaagaattcatttttctatataccaatacgttaaaaagtgcatcttcacgtctgtaaatactagtattaaagcgaatacgattactatccaaaaattgctttcgaaatacttttccccaaggtgtccccagaaaaaagccatcacttctaaaatcacgattttgtatttttagtaatttagaaattaaatccacgtcctgagcactttgttttccgttcttaccaattatattttggatgttcttctttatcacttgttttccagtaatataataaggaaacattatgacatcaacgctatcatcaatattatgaaatacactcatatcaaaagtaatataatcatcagcatcaacaaacattacccaatcaccatgagacttttccagtccaaaatttcgtgcaccagaaactccaccattagctattctaaaatatttaaagttactaagtttcaaatatttagttagataagctttaacatcctctgttgagccatcgtcaacaagtataatctcaatgttactttttgaaatgttattcagactttcacagcacttaaccagtaatcgtctgggagtattatatatgggaacaataattgaaagtaagtccacgcttcaaaaacctccatttatggtaaaaagctttgattatcatactttctacttactccgtcgtgaaatccttgtaaatacgttctaacaagtgccccggcattttttatcctctgtttgaataatagaattgcaaaaagctttcttaacaaaaaatacacttcgtataatctgattttcaatgcttttcccctatgcttttctaaggacaaaattctatttctcataacatagtattctttccagacagaaacatctcgaccagggtccgtggtcttatgaataaccttcgcatttgctaaattaatgaacggtacaacctctctacaacgcaaggcatattcaaaatcatcaaatttgataaaatattttttttcgggcaatcctgctttttctactgtttgtttattcaaaacaataccgacaaaagagaatatgtcataactaaaatctttttcatattctgaacgttcaataggtgacaccgtaagataattattgtttttaatattctcacgatgtaaggcatctaactgaccgttttctaaaaagactccgccggaaaacgcattctgagatccatatttttttacgcctgcattaattgctgcaaaaaattcgggtgtaaagattgcatcatcatcagaaattgaaatccattcagcatctaattccattgccttccttaatccaaaataataaccagcagaaccaccttgattggtgttcaaccgatcatacagaattcttttatcgctaaaactttgttccaccatctcttttgtcccgtctgttgacgcattgtcaattatgacaatatatttaggctgttcagtttgcgttaataacgactggattgcttcaactagtaactttttccgattataagttacaattacacttgtatactccatggttactcctcaattaaaaatgtgtattctcattacgtccaagttttcgcattatgaatgaatatgctttctttatcaaatatcgcttaccaagttgtccccatttattttcagtatatctgacattgttttgttctatccacacatccattaacaattcagaaatatacccaaaaactcgtttttcctggactgaatactcagaaatatcaatgttctcttctaagcgccctaaaacactaaacaaccaagtacaataatcatcaaaattcttttttttcatgataaacatgttaaacatgtgtgcacttcgcttcttcattattttgtcaaaactccctaaatattcaggataatattgctttataatgattcgcgtgacatccaagggttcctgcttatgtgcatgcacgtaatgactatagttagtttcaatgtagtagtgtcgttttgttggaagaatcacatcagatttctcaaacatcttttctatttgttgttgtgtaattaagttatttaacgatcttttagcggattttaaaaatacccttctgtagtgaattaatccgactgcatccacatttttcaagtttttccatgcccaatatactgcagtaagttcgttgtaagaatagtttttattggatatattttctccttgatcatctctttgatacgtaattctatcggtggcattttgggtagcaccaaccaatactggtaaatataaagttttatcctgcggcattggaaactgcttgtgagccgcgactagtatcttaatattaattaatatcccctgccattcattgaaaactattcatttaataaattaatcatttcatttgccacggtaatatcctttaaattttcattagggaagttagataccaccagcacaaatgcattggaactaccgtccattttaatactaatatatctgccataagagtcattttgatatgcttttccatttgaattgctaaaatatgatgatgctccctgatcatcatacaggacagatttattatctatacctatcttcttactattaaaaagatgaataaagcgaatcatgtctgaaattgacatatttactgtattattatgataaagaaaatcatcattaatttggctttcctgcactggtgcacctgattgcgtcttatacttgtaaccgattatattgcttgcgtaggatttatcattttccgttgcaacataagaactatataagtgcatcggatgcgcaataagcttttgaaaacagtcttcatacgataggtttgatgattgctttattaattgaagttttaactgctcattaccactaacgtatccttttttaggggattgtgaggcatcttcgtacatagttttactgttatcttctaatttagatttgtttatatatatggttgctgaacctcttaataactttttgattgtgattttactattcagctcagatacatattcacttactttatcctcagagctatgaatttgattcgcttgtaccaatttcataatcattatattgtttatcaaatattgcattgaaccgacatttagcgtactcgtcatcataaaaggaacttttttttgcgaattcgcatacccgctttgtcctgaaaaaactacttttccatttttaacaccaatgtaagcaccaataaactgttcatcactgacttttttttgtagtgtgaccaaccggttccttcgttttccatgcaagttgtttaatcccatattagttcttgttatcaagctatccgttactttctcatcagaattgaacttagtactctgatgggaattgttctgcacataaaaaaacagataccctagcataaacattacaatcagaattattaaacttacaattatatattttttactttttaacactgatataacctgccacatttactttccatctcgacaagacattcattgtcttaacaagaattcttttaggagtcccaatatcacaaattagaaaggaaacgtctgaaatatcatatagccgttgattagaagttccagaacgtacattaattttaggaacgttaattaatactctgtcatatgattcttttagatttactagaagggtctccatcctcggatcatcgattaaattattagttttactatttgtaatttttcccgcggaaattaaatcaatattctgattgggcacagattcgataatattactaattccaattctagtatgactcaaaaagtcacttaatccatattgtgtggttacattaaaagtacttgaaaaagcagtcgagttaaatttggtatctaaaattacgaccctctcgccagcctgtgaatacattaatgacagattggctattaaaatctcctgttcaccattcccgtatggtgtaataaattcaataactttttgattagacataacatgaccatttacttttcgaatcgcgttttttatatcatccatgactaatactcgtttactccttttcacgtgataggtttgttgcagcaattttatttaggccaatgatcttctctaaataatcttctgattgtacatttccaatataccaactgtagagaacgattatcagaaatgaaataataaataccaagataaaaatccccatgcctgcaatgatcatgtcgttctttttacttacaaccgtggctgttttagcacgctgaactaacgaaatatttgttccacttaaaaattttccaatattattcacaaaaatttgtgccgctgttgctgatacaaattttgcataatttgaattttcactactaatattaatggaaaagaaaggagaactagtcttattatcgatttctgcagtatagtcatttttatgagtatagtttttccagcttgactgatcaatttgggcattgatcatactcctatatttatcagattccacaaattgtttatatgacgtaatcaaattatagttattatcgttttgtactaattcgctagaactgctatattcagttacctttaatttcgtgtaaccaaacattcctaccaatccaaaaattacgctaactatgaatactggtataaaatatctttttaatatttttaaaaaacttacttctcgccaatctatagagcgaatcatcatatcctcctattatgccgaattattacaaaaaactaggaatcaaaaatctatactagttaagttcctgatttaccaaggttaacgctgcatgaataacttgatgcatatcgtaatatcgatattgtccaagccgaccgccaaaaatgacatttccttccttatttgcaagttcagcatattgcttgtagagtgtgttatttttcgtgttattgacaggataataaggctcgtcaccacgtttccagtttgcagggtattcacgtgtaattaccgttttatttgcatcacccttgccaaactcaaaatgcttatgttcgataatacgtgtatacggagtttcagcatccgtataattaattactgcatttccttggtaattatctacatcgagctcttcactttcgaaatgaagtgaacgatattcaagttcaccgagttgatattcaaaatactgatcaatcatgcctgtaaatacaatttttgggaaatcgtttaaatattggtccttattagcaaaaaaatcagtatctgtttgaacatcaatttccggatgatctaacattttttcgacaatttgtgtatagccaccaattggaataccttgataagtgtcattgaagtaattattgtcaaacgtatatctaacaggtaatcgacgaataatgaatgccggtagttctgtggctttttgtccccattgtttttccgtgtatcccttaattagcttctgataaatatctgttccgattaaagaaatcgcctgttcttctaagtttttaggctcgccacttaatttagcagcatctttttgttgttgaatcttagcctttgcctcttctggtgttctaacaccccacaactcactaaaagtattcatattgaacggtaagttgtacatatgacccttatagttagcaaccgggctattcgtataacgattaaactcagcaaattggttaatataattccaaatattcttatcggaagtatgaaaaatatgggcaccatactgatgtacttgaatgccatcaatctctttggtataaatatttccagcaatgtgatctcgcttttcaatcaccttaacatgtttaccacgcaaagccgcctcatgggcaaaaacagcaccaaataatccagcaccaacgactaaataatcatacttgctcaatttaaattcctccaaaaatataaaatctcattacaccattatagcaaaaataactgaatgtaaaaggctaattataagattatcgttttaacactgttaaaaagcgaccacctccatagatgatcgcttttcctataatttatgccttattatctacccaatcccaaagaacccatgcataaacaacgccgcacaagcagccccaacgaaaggtgcaatcccaggaacaatgatcccatattgccagtcgctgtcagccttgttcttaattggtaagatggcgtgggcaatccgtgggcccatgtcccgtgcaaggttcatggcgaatccggttgggccgcctagtcccatcccaatggcccagactaagagcccaacaccaatcggcacgatccccggcgtcttcacttcagaaatagctaaaatcccagaaataaaaataaatgtatcgaagaattcgacgaagaagttccgtggtaagttccgcacagcgggtgcggttgagaataagttccgaatcgtaattggggaaatctcatcagcagaagcggcaaaatggtccgcgtacatgatccagacgatcacggcaccaacgaccccacccaaaacttctgcaactgaatacgggataaacaatgaccatgaaaggttccctaaaatacattgggctaataccatggccgggttaatgcagacattgccgaaaatgaagagggcaattgtaatcccaaaaccccatgttgtaattgcgaagatatggccggaaccgcgatacttggtcccctttaaaacctcactacaatgtacaccgacaccaaaaataatcatcaaggcggttcccatgaactctgccaaaagctgatgaatcactatctttctcctcctgtggcgttgttacgcctgtttattttgaaatagacgccacttactttcagaaagcaccggcacttttttcacacgaacaccattatacacaaaatccgaatcgtttaatatgtaaatcgcaaaaagttttgattttacaggattaaacgttcggattcaattaaaaggttctgattattcttttttagtcgtttttttgcgtttgaagaattgtcgccgaatgcggcgaatcatccgtggagactttggctcaatcgtatgctcaaaccattcctgcaccgacgcattgacgacgccaccaaacatcaagagaatcccggaaaaattcaaccagaacatcagtacaattaaactcccaatcgtttggtaagtcgtaatccgtttagcaaataattcgatgtatacccggaacccttgcgagatcacgatccagccaatcgtcgtgactaacgcccccgtccaaatgtaacgcaatttcaccttggcgttcggtacaaagtaatacaacaacatggcgacgacgaacatcccaacaaaggtaatcaagtttttattttccaataactgattaatccaattcggaatgattgcacgcgtgaggttcgttaaattcaagatcacatctagaatcaactgactcaacgtgaagaaaatcgccagccctacgattaggagtaatagtcccaacgttaagaaaaaggcaataattcgcgtccaaacggcattttgggcatctgtaaccccgtacgcctcatttagactcctgcgaatcgcagcaataattttagacgccgaccagactgtcaccaaaatcccaattgacaaactactactgctgccactagacaggaatgaaactaaaatcggcttaaacgtctggtagacgttactaggaatgacttcctgagcgtacgctaaaatctgcccagacttcaaatcgaaccgggcaatgaggtttccggcaatcaagataatcggggcaatcgacattaacgcgtagtaggctagcacaatcgcattattgctgacattggcttgtccataccgccgaataataatttccaggcttttcgcaattttagggtaacgggcttttaaattcattcatttatcctcaacgctcacttatagtatttacaattatacaatggaatgccgcgggaaacaccttttatactaggattagtgctttcagcgaatagactagtcggtccaatcagatcaattgatggcaatacctgaccactgacgagtaaaatccgcttatctcccagccgtcagccactttgacaaaatcaagtagctgcttagacgctcagtggtactgggcccagccaaattttaacacaaaaaaataaccggtattgatacccccgcggcatccatctccggctacttcactaatttcacatctttacaggagaagtgaaaatttttatcactatgtcagtgcttaatattacactgtttatacaaaaatgtaaataattttaatgtgtaccaatttttttcataatcgcttgtaagatgtattccgcggcatgaccatcgccataaggatttttagcgtctgccatccgttggtacgctgcggaatcatctaacaggctggtcattgctgccgcaacctgctgaccatcagtgccgactaatcgtaacgtccccgcggtgaccccttccggtcgttcagtagtatcacgcaatacgagcaccggtttattcagtgacggggcttcttcctgcaccccacccgaatccgtcataatgaagtaactgcgcgccgccatgttgtggaaatcaagcacgtcgagcgggtcaatgaggtgaatgcgatcggtatggccgaggatacgtttagcgactgtctgcactgccggactcaagtgtactgggtagaccacttcgacatcgggatgctgagcaaccactcgtttgatggcgacaaagaccgcttccatcggggcgccctgattctcacgccgatgcatcgtgagtaagatcatccggtgcccaggctgaatcaaatcaagcgcagcgtgttgatagtccatcgaaaccgtctgttttagggcatcgatggccgtattgcccgttaccgtgatggccgtatccggatggttttccttcaatagattctgccgacttaattcggtcggtgcaaagtacatgtcggccagcacgtcggtcagctgccgattcatctcttcaggatatggcgagtacttctgccatgtccgcaaccccgcttccacgtgtccgactgggatttgatgatagaaagcactcacactagctgcaaacgtcgtggttgtatcgccatgcaccagcacgatatcaggcttgactgtatccataattgcatctagcttcgtcagtacccggctggtgataccagctaacgtctgattaggcttcatgatattcaaatcatagtccggcgtaatgtgaaaaatcgtgagcacctggtctaacatctcgcggtgttgagccgtcaccaccgttaccggttcaaattgtggctgttgctgcaactgcaacacgatgggcgccatcttaattgcttctggccgcgtgccgaaaatcgtcattaccttaattggttttgtcattaactttcacctgcatcatttagtttctaatctcatcatagcgttagttacgtcgtggcgccatcatttcgagtaaaagtttagttattttcaaggattcagccaaacggacgggtaagcaaaaacaccaccttgattgcaggcacacgttctcccgcaattaagatgatgttcagcccgtaccgtttctaaaaaggtaccgtcttcaataaaatatcacgaatcttatacgcgacctggttgtcaccaccaaaaacaccctgattttcaaataagactaaggcgactttggcatttcgcgaccccatatagtagctatgaaaattattgtcattgccacccactcgaatcaactggcctgcctggtaataaacgcctgccgaatatttaatttgaaaattatccgcaagtgactttaaaccggcttcaccaactagctggccgctttgaagcccatacataaatttataataatcccccacactcatatatagactaccacagcctaattcactagattgtaacggcttagaaatgatgccactctgaccaaacccattagccaagcgatacgaagtcgggttgatcacattgcccggaatatcgttatattcataggtatgttttaatcccaatggccgaatgatgtcattagtcaaagccgcctgataggatttatgcgtcactttgcgaataacccctgccaataaggtaaagttcgcgttggaataggcataagcatgattattcgtcgaccgtaaatgttgcagtgtaaagttcagccgcgccgtctccgttggtaaaatcgtctttggtgttatctcagtcatccgaataccggaacgatggtctaatagttcacgtatcgtaatctgattggcgtacggaatttccgggtaaaagtgactcagcttcgtcgtcagactcaacttaccctgattgatcagtttttgaatcatcacgccagtcacagctttttgtaatgacgctaatggataagcctccgtcgcagtattgcggacttgattggcatcatccgcataaccatacgttcgaacccggacccccgccggaccgttcgtggtcagtaatagtgtccccataatatgatgacttttgatcaactgatcgatttgcttgattgcctgggcctcagtaagctggccgggcttcactttaggcttagtcgtcgtttgctttttcgtcgcggatttgatttttgacgctgcctgctgtactttaattgtctttggtgtcacttgctgtgctccttgacctaattgctgtgatccccacacacccacgccaatcaaccccagtaagattggcaataaacttaataaccaacgccgtttgttcatcatgatcccccctgttcctgatgagtcgcccgtcaaatctgacttgactactatttaattgccccaagcatacgccctcacttctgactttgcattaaaatgcgaattattgttagtccgccgaaccaaatcgcaagcgctatcaacagcacggttttaccacaatcactaaaaattcatcaaaatttagttaatttaactcgtgcaatttccgaacgtgaccattaaaatgaagattatagttaacttattcaaggaaggatgatcatattgagtcaagcaaccgattatgtccaacatgtttaccaagtcattgaacaccgtgatccgaaccaaaccgaatttttagaggccatcaacgacgtcttcaaaacgatcacgccagtcctcgaacaacatccagaatatatcgaagccaatattttggaacgtttgaccgaaccagaacggattattcaattccgggttccttggctcgacgatgctggtcatgcacgagtcaaccgtgggttccgagtacaatttaactcagcaatcggtccttacaagggcggcttacggttacacccatccgttaatctgagtatcgtcaaattcttgggctttgaacagatcttcaaaaatgccctgaccggcctgccaatcggcggtggtaaagggggctctgatttcgaccctaagggcaaatcagacaacgaaattatgcgcttctgtcagagtttcatgaccgaactgagcaagtacattggtctcgataccgacgttcctgctggtgatatcggtgttggtggccgcgaaatcggctttttatacggccaatacaagcgactccgtggcgctgaccgcggcgtactcaccggtaaaggtttgaactatggcggttcgttagcccggactgaagctaccggttatgggctcgcctactataccaacgaaatgctcaaagccaaccaactttccttccctggtcaacgcgttgccatttctggtgctggtaatgtcgccatctacgcgattcaaaaggttgaagaactcggtggcaaggtgattacttgctccgactcaaacggttacgttattgacgaaaacggtatcgacttcaagatcgttaagcagatcaaggaagttgaacgcggtcgtatcaaagactatgccgaccgtgtagccagtgccagctattacgaaggttccgtctgggacgcccaagtagcttatgatatcgcgttaccttgcgccacccaaaacgaaatcagcggtgatcaagccaagaacttgattgccaatggtgccaaggtcgttgccgaaggggctaacatgcctagcagtccagaagccattgcgacataccaagctgccagcttgctatatggtccggccaaggctgccaatgctggtggcgttgccgtttccgcccttgaaatgagccaaaatagtatgcgtttgagctggacttttgaagaagtcgataatcgcctcaagcaaatcatgcaagatatctttgcacactccgttgccgctgccgacgaataccacgttagcggtgattacctgagtggtgctaacattgctggcttcacaaaagttgctgacgccatgttagcgcaaggcttagtttaagccaactacatttaatcgcatcaaaaaaacggattgtcattatcgacagtccgtttttcattattattaatcataaaatcaagttaaaccttatcagccggataacccgtgtgcgcaaccagttgcgcgtaggtttcatgtaacgtcacggccgcgacccgccagccgaccttcaaaagcggaatcaaccgcagtgggtcttctaccggcacttgatgttcatgggcgaacttacaaatcgccggtaaaacttccatatcagaattagcaaaataataattaccgctatcagtcagcacaaagatcgtcgcccgaaatgcgtggcgtgggtcgagtccttccgttacgtgacaccgaatcgcaccgatctgaattcgccgcaccgcactcagtggcatttcacccagattgcgtccttctggtgaccacaaaacgacctttgtcggggtcagttcgaccattgcgtacttctcgctcgacgtccccgataagcgccgtaaccagttacgttctggttttggctttggatactcctgtccctgaatctcaaaatgaaatggaaccacgcacttttgcgcccgctcaatggcccgataatgacccgcaatttgatggttcgtaaaaacagatgccattggtttaaacataacactcacccctctcaccgtcagtatacgctttcatgtgacaatttacagtgatttcatcacgacagttttcattttttgtcgcagtgttcggctgaaaataagataaaaatagcggccaaattacagcgtaacttggccaccacgatacttaccagcttggctcaaactatgtgtcaatattcactgcccctatgtgtgctaaccgacttgcggtcacccccgctttgaaccattccgataagcctggatcaaagtaataattgctgaagtcaccaatcagaccttctgacctcgtcattgcaaccgcagttgcctagtcaactctgaccatcattattatagcacctttgttaacggttacacaacgctagaactcattccttaagtcatcaaaaaaagcttgccagtttgacaagctcttggattacgcttattcagcatcattgggctggctatcatcaaagtcagctggcatgatggcaaagttgctagcttcagttgacaataatgctgcataggcccggactttggcagacaacgctggaatgatggcaccattcaaattgttcaacatttcttgttcgtcgtcttcaattgatttgttgtcagattgacgttcaataattcccaccatctcaccacttaggcgtacaatcgcaaaaacggtcgcggataagtcgaacatttcttctttataggtcacttgtaattgagcctgcacaacgtcatcgccaaacgtcttcttaacatctggattggcggtcgtatagctgaattgcccctgaccaggattgtcatcgtcttcagaacgatcataaacgatttggaaatgtaagtcttggattgctgagtttaagatttcaatattcatttagccaaactcccttttatatattactcccaccataaaggaaaacttggcaaaatacaatcaaatttgccggctttttgtgaataatccgttaatatgccgttaacgttttgtaaagtcagtaacggaccttaggttgacgctgactcgaattacttatacactaaataaggattttagttaaggggggcgttctatcatgtcgatccaccgaggattaccagtgctcgtcatcctggccgtctgtggcggtttactgaccctgccggcaaccaatgcacaagccttgcgagttcggggaacccgtgtcacaatgcgagtcaagcaccgggcgaagccgtcgaagcaccactactcgaaacggtcagcccgctcacacaacgccaggcatcatcattaatttattgcaaatctaactaaaaaacgattagcgtcccggttacgagacgctaatcgtttttgtcgttctattcactgcatgtataactttcttaaccagatcgctcaccagtgttgtcttaacagcagtatcactgccacacaacgtaactaattttgtacccgttgtgcgtttttttgacgaaccttgtcaggcatcgtttcagccagtaagtactgtcgaatcaggctgacgatttgcttattctgtggtagatcggagtgcgccgtattcgcccccgttacagtaatctccgtaaaatgcttgacctgatcttgaaagatgtacttaccgtagttaacgctgttatacggcaccgtcccatcactggtatagttttccgtccccgcaatcgagtaaacggttaacgattccggcaaaccagtccgataacggtaaagttccttgaacatgctcgtcttggcggtcgtacttgtcgattccatattgtacggcgaggcaatcgtcattaaccggtcaatatgaaccttcggactttcctttagatagcgctctaaaaagagggtccaaatgaggccaccattggaatgacctagcgcataaaagtgattaaagtgatacgttttgaccaacgccttgaatgccgtattcaaccagacagcttgcttatcaatattagctttaccatcacgattattcgcgaagccaatcacgatgaacggctcattatcattagcagcaatcgaaccactatacttaattgtcccatccgtctgaactgtcagcttcaatacactgtgttttttcggcgtttccttccccaactcggtaatcaaactatcaaaccggttctgtgacgcactcgatccggggaccataataactggtgccatccgcgtccgaccagtgtttttcagcgtcttgatattcgcttgactccacgtgtaggccggccaacagatcccgactaacaaaccgattccaagaagccaccgccaccaatatcgtttaagcatccgcctgcgcctcctcctcaacctggtttgccaataggacaaatggcaagtagattgctgtggctaccgctatattgatcagactaacgatgaaggcccgccagtcgccaccagttcccagccaaccggtcaagaagcccggcatcgttctaccaaccggataaacgaccggcggcatccattgaagcttcaacgcgcaccacgtgatgaccatgctagccagtggcgctaatagaaacggaatcgctaaaatcggactataagcaatcggtaagccgacgagcaacggttggttgatattaaacagtactggcaaggcactggtcttggccaccgttcgataattacggttacgtgaacgccacaaaattgcaatcaataacgctaacgtcattccgggaccacctacgttcgcaaacgcatcaaataacgtatggagcgttactggatttggcgcgccccacgccgaaccgtgttgcaacgcatattccaaattttgaaccgtactcgtagtactgttaccactaaagtcaaccggaccgataatcccaattaaccagtataaattgctgagtgatgccacgccaattatcgctagtagcgacgcccccggattactgaatggtaaggtgaagaccgcgtaaaacaggccgtttaatccccctttactgacaaaactaacaccatacccgatggcactgaacaccagcaaagcagcgactatcggtaaccagttcgcgtgtgcccgcgctagcaagtgggtctgggtctcgatctcctggtggatgtgtggataccgtgtcaaatgactgaacaaccaaccagtcaacaggcccaccaatagtgcgaggaagatgccctgagttcccaaattatcttctaaaaaccgactgccagcaggctgaccctgggtactaaaaaaattataattgatattaagcatgataaaactaattgccgccgtcaatcccgctaacagattgtcacgctgggcactccgcgcaacaaaattagcagctgaaaaagccgcaatcacggcaaggatgccgttgatactcagattaagcatcgtcgtgtaagttgccaaatgtttaaaccccggcagccagtgactgagataataaatatgattcaaaaaaccattgcgctgaaagattgcctggttcataaaactaacgtacgccccaactaatgcgaatggaaaaagcagcgtcaacgtatcacgtaaggcgcgccaataacgttgccgctcaacgacccgttcaaaggtcaataggctgttctgtacatgctttaacatacctaacccccaaaagaaatttactgtctataatatacgctagttcatcgaccttgcccactaggtgcgtttaattttattgcccaacactaatccattataattatcgtaaagataactggaggtggttataatgccaagccgttacacaaatattttagtacccgttgacagttccgatgctgcacaagccgcttttactgaagcggtcaacattgcccagcggcaccaagcaaacctgactgcgctctacgtggtggatgacagcgcctaccacacccccgcactcgacccggttctatctgaattactagacgcggaagccgctcacgcaaaggatgccatgcggcagcgacaacaattcgtcgccaccacgtccgcaccgaatttaaaaactgaaatcagctacgggattccaaaacacaccattgaggactatgccaagcaacatcccgaaattgacttgatcgtgctcggcgccactggtaccaactcgccccatcgcgtagccgttggttcaacgaccagctacgtcgtggatcacgccccttgcaacgtcatcgtcattcgttaatcgcaacgcccgctactagtcatttggactggtagcgggcgtttagactaatacagtattcatttcgatttcatatcatttgtggctacttaaacccaaagcaccgttccaaggtaacgtcactaaaacgctgccctgaaacggtgctttctaatattcaactgacctcacccggactcgaaccgggatcaaccgcttaggaggcgggtgccctatccagttgtgctatgaggccattaacaatccgtaaaatatcatctcacggattgtgcattttggcaattactggttgctaaagcgatcacgatttttcttgcgcatcccttttttcttagaatgcttattgtgacccttcttctttttaggtgttgccgcagcgggccgtttccggcttgtctccactcgtttaacctcatctgggtgaccagcactcacgacccggtgccgaccgttagccgcgttgccagccgtttctggatggtcgaacgttaacggtggaacaactttatctggtttcgtatcaacaatatgataatcaaccaagtaacccggcttgatttcatagtcggtcgtcgccatcagcttcttaaagtcgcggacatcatggtcgtcaccgaacgtcaagactagtccatcagcacccatgcggcctgtccgaccgctccggtgaatataagtcgtgacatctttaggtagctgatagttgatcacagctggcaattcaggcacgtctagaccccgagccgccaaatcagtggtcaacaacagcccgactttgccttgccggaataaccgcaacgctttttcacgttcaacctgacgttgattactggtcaaggcaacgtaactcacgtgctggtgtcgtaattctaaggcgacatgttggagttcctgcatcttattgaagaaaacgagggcccgcatatggtcaacacgactaatccgtttcagtaagtccacccggtgccgattacccacttgcatcgtccggtgccgaaccaccccctgggtctgatcaatggcccgcacatcgattttttcaacatgctgaccaaaccagcgtggcaactcatctaaaattttagtttcggttgctgagaagaagcctaattgtaacgtttcagcaaatgtagcgtcgagaatttcacgaatctgatccaaggtttcatctgtcagtaattcatcggcttcgtcgacgatcatcatcttcaaatgcccaagcttgatcttaccatccgcaatcaggttagtaatccgccccggcgtcccaacaattacttcaggatgctttttgagcttttccatctgccgcttaacgttagccccccccgtaatcgcgaggactttggcatcgatcaactggccccactcgcgcaccacgttggttgtttgcattgcgagttcttgtgatggcgctaagatcagtgcctgcgtgccttctccaacccgcaacgcttcgagcattggccacgtaaacgctagggtcttaccagaccccgttggtgcgagtcctaacaccgattgaccagctgcaagtggctcggccactgccgtttgaatcggcgacaactcggtgaaccccgccgccgcaaatttagttttaaatacgtctaacatagtgcctcatttctatttatcggtatcaggggcttcacccgtaaaatataggtgccctgactgccgcaaattaaataatagtttattaacatttcgactaagttgccgccaagctaagtattccgtctggtgattgcttgggtcattgataacggttgcgaagtcgcgcgcctcggccagcattggattggtatcgggttgcgccccaatcgcatgctcctgaccatccttatcttgataagtgatttgtccaagttcagcaggattatccatcacaatagcgtcgcgcagaccgttgatttcagatggcaagaacgaattactagtcttaccaacgttcaaggtcaccgtaaagtcagcgtagcgtaaaatagccacacccttaccgtcaacgcccgttcgaatcaaggttgggtagtaagccacctcttccggcatgccgaaccagccgaccgcatcgtaggccaggtacacacctaaatcctgaagcgccccaccggcaaagttcaacgagaagatattcggttcttcaccagccaagacggcgtcataccgtgacgagtacttcatgtaagtcaacgtcgcaccctgaactaaggataactttttaatctgatccttgacgcgttggaaattaacttcgtgaatctggcgtgctgcttcaaataataggacatcagggtgagcctttaaaacggcatctaactgttcaaattcttgttggttcgccacggctggcttctcgacgatgacgtgcttaccataggcgattgcttgtttagcctgggcaaaatgcagactgtttggtgacgcaatgtagaccgtatcaaaactaccccgactgaaaaatgcatctaaatccgtaaaagtctcatcggcatgattcttggcggcaaaagccttcgcggtctcagcatggcgggaataaacactcgtcaattgccattcaccagaggcagcggcagcatcaataaattgttgtgtaatccaattcgttccgataattcctaattttaacatcgatttgactcctctcaacggcgctagtcaaccagtcgtgattggtggcgcttactcgtgcgtttagtttataattctattttaccagttttcgccgttaagttgggccataaggatcaaaagtcacccgctattttgcgcataaaaaaagagccgccacacgggcagcccttttaaaagctaagcttattgaggaacaacgttagcagcttgtgggccacgatcgcttgattcttcatcaaaggtaactttttggccttcttctaaggtcttgaaaccgtcagtttggatagctgagaagtgaacgaatacatcgttgccatcttcaccagtaataaagccataacccttatcagcattgaaccattttacagtaccatttttcatgaactaaatcctcctaggatataaaaataaaaagtaactaacacatgttattaacacctataaagaatttacggtaacacaattaaatgatactttaaaacttcacataaatgccaatcacattatatagattaacacactcacccagtaatttccaatcagaacacaaattaattcaaaaaaattagttaccgcccttccgaaattgataaaatattacgttcattacccgcaggtaacagtgacataaaggctttaataagaatccacttattacgtgacgttaacgccgttttagtggtatattttaactatagatttattcagaaagaaggttgatccagtgaagcggcgtggcgcaatattatttggtttatcattacttgcaggactttctagtacactactccacaaacggcaccctagtacgatcgctgacggtgacttagcggttttctacgcgggaacttggacctatcgtgatgaggctcatcaccgggaccacacgttggagattgatcccaacatgatgattcgcatcgacgggcgctcggtaccagccaccgtcgaatccatctcatcgagtgcgctcgtcttacttgatcaatatggatttcaccttgaggtgcgggctaatgagcaacgacctgtaaccctctttgacgaagccgatgatcgcagttatgtcatcttatcgccaaatacctaatgacgctagtgacgtcctaaggattttaataggtcgccatcaaaataagtcgcaagttcaagaagagtcttgaacttgcgacttatttttagtcagcctagcagctaataagctgttaatttaatttgtgaaataagttattcaaggattaggccttaatttaagccctgcgccacaactttattgtacgctgtcacactaccgttgaatagaattccagcgaactcttgacgagtcccgttctggcggtaaacggcgcgatcggaataatgcataaacatcactcgttgtccctgttggtgggtcttcgccgtgtccagccataagtcagtgtcttttagtgcgggcttaacgatctgcttggcaactgcgggcgttgaccatacgacgcaggagcgattataatcctggttcaacgtggtcactaatgccttaagcttggcacgactttttcgaaccgcaatcgtctggtccgtgtagtcaccgtagtattgcacttgaatcgcaattggtaaattgccgatgctatccccgaccgttttctcgaaataggccgcttgggccgcagcagtcgatgaaaaactaaacgtatggattacgccaacacctaaacttgtgccaacgattcgttcataattgcttgcaaagttatcatccgtataactagctccttgagtagcgtgtaaatagacaaacttgagcccatcattttgcaaggccgcaaaatctaaataaccgtcattttgtgacacagcaaccccacggacatcaaacccactcacgacagcgtcactacgccaacgtaaccaagccaagccgccccaaacgctgccaatgattactaatagaactaataaccagcccagtcgataacgccaccgcgcccaccgcgtttttgcgtatactggtcgataatgttgccgctttgtcatctcatcaatcctttgcctacagcattaaagctccgttcgtgtttgactaatggcctcgcgaacccggccaagactttctgccatttcgatattgccatgaacagcagtcatcaagaagagactatcgataatactcatctgggcaatcaacgaagtcagcccttccgaacgatagttaatttcttctgcaactgaaataaaggcaacggtactgtccttagccaggggcgagttaccgaagctagttaacgcgatcactggcacactttgtgaagtcagggtagccagcacttgtagtgtttgctgattacgcccggtatgtgagataaccactgccacgtcgctggcattcatctgagccgcttgcatcagttgcatatcatagtcactattatgggcacacggaataccggtgcgcacaaacttatgatacccatctaaggcagcgactgcggagcccccgagaccataaaagccaatcgagcgagcattcagcaataattccaccgcccgcttgagatctgcttccgtcattacctgacttgtctgatctagcgaactacgaatactattgaatgttgattccgcaattcctttgaaagtcgtttgtttttcgacatcttgaaaagcttccgcattagtttgttcaatcggttcggccgccgttagttcacgtgagaagtcacggaagctactaaaactaatccgtttgacaaaccgtgaaaccgtggccgttgaaacgccaaccgcggcagccaagtctgaaatcgactgagccgccgttttaattgggtcggcaataatatagtcagcaatcttgcggtccgtcacacttaaattcggataataagaccgaattaaagtcaggacccgattgcgatgtactggtgattgtgtggacatttcggccacctccatgaccaaattttaccacaattcttaataacaccctaaacttcctcacaggtgccaccgtcacaaactcttgaacactgtccagtccacaacgactgaacctcgttgccgctcattcgacagtccccgtcgatactaagcccttacgagtctgtttcggcttatccaacatgtaagttctaatcaacgtgacaatttgcgcattttgaggtaaatcggagtgctgggcattcgtaccagtaaccgtaatctctgtaaaatgcttgacttgcccttgatagatatacttgccagcctcgacactccgcgctggaacaagaccgtctgaatcatagttttcggtacctgcgaccgaatacattgtcgctgacttaggcaatcgatcgcggtacttaataaagtcagctaacatttgtgtcttatgattcaaattagcttctgagaaattgtaaggtgagccaatggtcataattcgtttgaccttaatatcgtcgcgattaaaatagtgttcaaagtagtacgtataaatcagaccaccattcgagtgaccaattgctttgaaattattgaattgatacttggcagccaacttcttaaaggccagtgagaaccaacgggcctgatgcttaatattatcatagccgtcacgattattttgaaagccaacgacgatgattggctcgttatcacgggcacgcaacgaccccgtcattttaatcgtatcatccgtcatcacggtcagcttaattaaactatgccgacgatgatcagccttattaagttgcttgactaaggtgtcaaaccgattctgagtcgcactactgccgggaatcataataattggtgacatctgcgaatcatggcgtcctgccatcgcagccacgttggttttcgtccactggtatgagggctgaatcaaaaagcccagaaatagtaagcctaatacaagcactaacagacttcgccgccgtcgctgccaattaggtcgattatacatgcttagcaccccccacttgtgcttgcgccgcctgcacaatggtttccgccaaccgcatgaacggcaaatagatcaccactgatagtgccaaatcaacgataccaagtaaaagtgccaccacgttaccgttagtgccgataaaggcaatcaacggtcccggcgtacccacgggaaccggataaaccacgggtggaatccaatgaaacccaattgccagcgccgccagtcccatatttacgacaggcgcaagcacaaacggtattagatagattggattatatagaactggtaagcctgtcagtagcggtccattactattaaagagcgcaggtaatagactccaccgcgcgactacgtggtagttatgattgttgctaccgatataaatggcaatcactaaggccagcaacatccccgttccgccaaacgtcccaaatgcgtgatacaacgtgttggccgtatacggatacggcacgtgatacgccgagtgatgtgtgagtgcataattcaaattggccgtcattgtcgcactgttagtcaccaagcgttcttggtacggaccagctagtccaagaatttctaacaacagcgtcacaactgccatgccaaaggtcagccacagactgtgactagtcgttgcgtacttttgaaatgccgaccaactttcagcagagtacgtaataatcatcagccagttcaaagcgaggctcactagcacggccaatactagtattaaggccattggaagtagtgaactgaaagtccgtgtcaagatatcggccgtatgcggactactttgtgccggaaccggcttgctgaaccatttgaagagcaggccggtcaaaccacccacaatcaatgcgcccgttagaccgttagtcccgatcaataaagtgttaaaaacaccaatttgattttgattcgtatactgataagccacgatcaatagcgcaatcgcggcggtcaatcccgctagttggtcatcgcgctgattgagtttggcatggtattttgccgcaccaaatgctgctactacggccacaccgttgagcgtcaaggttgttaaactatcaaacggatagtgtaagtaacgatagtatgggacccattttgacaggtgaaagatactggcaataaaccccgttttcgtcaacacggtcagttgaatgatttgactgaacgtcccaatcaaaatgaatgggaacgtcaacatcaaggtccgttgaataatccgatagaagttagtttgccgaaaacgcaacaagcgcggcactaaccgttgaattaaccgttgttcatcaagccacacaataccgcccccattccggtaatctactgaacttcattataagccgttttagacgctgctgcctattaaaatctgttataaatttacatgctatgctggtatcaaccatacttatatcggattgttaatttaatctgactggtcaacaacggtgtggcttacgctgagacagcaatctgattacaccaaaaaaggccacgccgtaattgcagcgtggccccgtcacctaaatttgatcgattatcgccaattgatcttgctgagaacgcgttttcctaagccattttgcagaacaatgaacaccggatacgcactgatcatcagtggtaggtaaatcacagctaacgaccaatctaataggttaaccaatgagaaaattcggccggcaaacaaaaagactaggacgaacagtgttgccattaacacgactaacccaattttgaaccggttcaacggccgggctgcaatcaataacgcatttaaactaaagatcccggtcatcaacacactcaacgtcgcggtcgtttcgaaattcagctggaacttattacctaacaccatgatgaccatgatatagccgaccacgcagatcgccgcgggaacggcaatctccatcacctgtttcataaagcgcccggtaattcgcgtataatcaggctgtaacgccaagaaaaaggttggaataccaaccatcaacgatgaaatcggtgttaattggatgggctcaaacgggtagctgtggctcatgaagataaaaatcaacgtcagagcgaccgaatacatcgtcttaatcaagtagagtgcggcgacccgttcaatattattgataacgcggcgaccctcgttcagcacttgcaccatcgcatcaaagttcgaatcgattaagacaaaatcagccaaactcttcgtggcttcactcccactcgccatcgcgatactacaatccgcctgtttcagcgccaacaaatcattaacgccgtcaccagtcatcgctacggtatggccgttgcgctgataggctttaattagttgctctttttgttgcggcgtcactcgaccgaacaccgtataatttgtcactagctgatcatagtcgggggtagtccccacttgactcatatcaaccagccgatcagcgtccttgatctcagcccgttgtgcaatactggcgaccgtcaccggattatcaccagaaataacttttagggcgacgtcttgattagcaaaaaaaccaaacgtcgtcttagcgtgtggccgcaactcatccgtaatcagaattaatcccaaagtcatcggtcgagtcggtttgggcgtcgttaaggcggccacttcggctaacactaatacccggtaaccttgttgcgcgagcgttttgatgcgagactgtaactcgccgggtaccgtggtaaaaataaattccggtgcgcccataacgtaagcgtgaccatcaaacgcagccccactccacttacgacttgaagaaaagggaagaacttctgtcgcttgcactggtggctgaccaaaagcagtcttgatggcccgggccgtttcattatcatcatcaatagcagtgactaacgcagctaaccggtgctccactgctgtcaaatcatgctggttccacggctcaacgcgttcaaaaactaacttgccactagtaatcgttccagtcttgtcgaggcacaacgtatcgacccgggccagtgcttcaatggcgggtagctcccgcaccaatacctggtgccggcctaaagtgaacgccccagcagctaaagcgactgacgttaacagcaccagtccttccggaatcatcccgaccatcgcggccaccgtcccgaggattgcccggttctgactttcaccccgcatcatagtggaaatgaacagtccagcacctagtggaataatcgtaaaagtcaaaattttgataattcgattgataatcgttaacaattgacttggcgtccgccgtttttgcttagctgctcgcgccatctgcttgataaaactgccgtgaccaacctgcgttgcctgcacgattccgtgaccaccaaggatgacactcccagaaaccagctcatcacccggccccttaataaccggatcagcctcaccagtaatctgggactcatcgacctctaatccagcggtcgcccgcacgagcccatccacaggaatctgctcgccacgggtcactaatagtaaatcatcctgaacgatttcgtcctgaccaatcgccaccgtttgaccgtcacggcggacttgaaccttagtggccgataataatgccagcttatcgacctgacgcttggcacgaatctcctgaaaaataccgatggccgtgttgacgatgaccacgaataagaacagcatgttcttatagcttcccgtcaaaaagactaatccggctaacaaaacattgatacagttaaaaagtgttagcaaattatcacgaaaaatctgtttaacagaccgcgttaagggcggtaacggctcattctttagacccgctgtcaggcgctggtcaacttgcttagtcgttaacccgtgttcaattgctgataaataacgttccgacatggtgggcccccttaaaattaactttaaccttattgtaaacgattttttaagcctggggccaaaataacgccctaatttagcgtttaccatgcagaattaagattttcattacgattgatcataaaactacttcaataaatcattattgattttgatttcagccttaacaaagattattgtattacgccccatttactgctaaatattggcgaatttaacctataaaaaaacggctatctgctaagatagccgcactgaatcttaaattattttttcgtcttatcagcaggtaagtgtgtctggtcaatcgctaactgcataaccttcgtgaaccgttcatcaagttcagtcccctgcatcttaaagaagccgccaatctcttggataatgaatccgaacaacgtggaacggtacaaggtattctccacccgcgccgaatcatccagttgtaatggtttaaacatatcctggtataactgcacaattgctttacgagaccgtgggattcttaggttatcatttaagtcaagtaataacggtgccaacccccgatgctggttgcaggccgcccggaattcttgagcaaatgccatcaaagcctcatcaccgtcaacgtctgagattgtttcagttaaacgatccgcaacattttgaacaaattggaggccaacctgatctaataaatcactcaagctatcaacataattataaatcgattgcggccgcacatccaaaactaacgctaaatcccgaattgttaatccgttaattcccttgctttcaattaactgattagctgttgctaatacttttgcctgtgtcagtgttcttctctttaccatcatgctcccccatttatcggtttatttcgtttatcattataacccaaactggtcaaaaaccgagatgaaatacatacttttatcaaaagtaatacaattgatggtttttgtgggtgttttttgaccaataaatacaattatttaatttaatacgctaaatttgactcaaacagctccagtgaactagtttacagcaattacagcgcattatttattaaattatttaaagcaataattataattatcaataaactgttttattagccgattctaaatgatctgtctattaaaatcggacgaattcaaatcaatatcagcgcttaaaaacggttattttgtgcttctaattcaaagttagccctcaagctgagtaaaaaagtgtgttggttacccgacaaataatcaggcacccaacacacttttcataatttcattaataatccagttttaaaatgcttattgttcgcgttctaacaccgttaccgattcaatatgtggtgtttgtgggaactggtccacgggttggaccggggcactaatatggtagccgtattctgcaaaccgttgggcgtctcgaactaaggttgatgggttacaactaatgtaaaccacccgtttaggcgccatttcaccggcactcttgataaagtcggcgtccaagcccttacgtggcggatcaacgacgatcacgtccggcttaacgccatctgcttgccatttagccatggctttttcagcgctatccaaaacaaaggtcgcgttcgtaataccattcttatccgcattctgccgtgcgttatcgatggctgctggcacgatttcaacaccatacacttgcttggcatgttgggccatcgttaacgaaatcgttccgataccggaataagcatcgatcaccgtctcattacccgtcaaaccagcttgatcaatggctaactgataaagcttttcggtctgttgtgggttcacttgatagaaggactgggctgaaatggcgaatgtcaggcccagtaactgatcatcgatagtggccttaccagctaacacgttgttaactggccctaagatcacgttagtcttcttagaattaacgttttgaatcacactgacaacttcaggtaacgctgcttgaatctcttgtgtgaccacgtcagccattggtaagtgtttcgttcgcgtcacaataacaaccatcatctcatgactgtaatacccacgccgtaccatgatcgtccgaatcgtcccactatgatggaattcatcgtaggctgcctcgtgatatttccgtaaaatatcgcgaactaccacgatagccttatcaattgcaggatcttgaatataataatcttcaattggcatcaattgatgactgttcttcttgtaaaaaccagtcgttagttgtccttggacttgtcgtacgggtacttgggccttgttccgatactgcgtcgggttggccataccaatcgttggtaaaacttcgacatcatccatgtggacctttgcaaataattcggccacctggtgctgtttaaacttcaattgttcactgtattccaagtgttgtagtggtgcaatcccggtttgacgataaacgcgccctttaggattaacccgatgaggactcacttggttaatcttttccacatcaccaaacgcaaagttcttcgtcgtcttcgtgaccttgaccgtaattttttcttctggcaatgcattttcgataaagattgggtaattatcgactttagcaacacccataccctgataggttaaatccatgatagtgacgtctaaaacttcacccttgtgcactggtaaattaactttcatttgtttcctcttgctttctttgttagtgacttattaatttttagttactgcctggtagccactgctccgggcagcgagtgatatggtcattaatactgccacacttggcagtgtcgttaacatttactgattaaacatgctattcaaattgcttaccatgagtgtcaaaacgcgcgaatttgagctgtctcatgctttgcaccactgacaaatcattgctaaaccgacaaacgattaaatcgtcaggcaatgctcaatcatgtccctgtgacggtaacacttttaaaaaaattaccgtccaccattgtatcggtaaacggtaatttaagcaagttattctgttttttcgtcgtcctcagttgcagctggcaactgatcaacggctgagacaaagtgtcgctcagcgtcttccaactctggatccgtatccgtgattgcctcatcggggatccgatccgtatcggcaaacatttcgatatgttgctttaaattccggaacgtcatcggtgcatcaccaccgtactccccatccaaattgatcattaagcgatccttgtcagccggtttggcgacgaccttgctcgtcttcacataaataatgcttggatcattgatatgcttgccaccattgagcactaatgtcattaagtgaagcattttggcaaggttgctcgtcttcacaataatcatggtaaatttaccatcatctaatgacgcgtccggcactaactgctcaaagccaccaactgaattagtcagcgctaagaaaaacatcgaagccttgccctgataatgaccaccatcatatttcaaatccatctcaactggttttactcgtggtaataactcagcacccttggctaagtatgccgcgtacccaaaaatcgacttcaattgtgatggtacgtcataggtcagctccgttaacatgcccccagccgcaatgttaatgaaatactgttcaccagcctgaccgatatccatcttaaccgtctggttctttaggactaccttggccgccgcaaccggatcattgcgcggaatccgcagtgcccgggcataatcgttggtcgtacccgccggaataatagccatcttaggtcgccgctttaacccggctaacccgtttactacttgattgatggtcccatcaccaccagctgctacaatcagttcaaacccgtccttggcacaacgtcgcgcttcatcagccgccgaattaggggcgggcgtcgttgcgaacgcactggtctcataaccagcttgttcaaagataccaagaatttcaactaaatcgtgggccaatgcctcacgtccagaagtcgggttataaataagtcgtgcccgtttacgcatgtttcctattcctccgctcacacggtcaagcgttcagcgtctcatccctactccaacgctggacatgcatcaatcgaggctcaacaccttatcgaccaacgcttctaccgtgcttttaatgatgtcattaatagttggttgacgactttcgggttagcttgaccacgtgtcttcttcatgatttgacccacgaggaacccaacggcccggtctttcccgttcttaaagtcatcaattgattgttgattattatccaatacgtcgtcaacgattggttgtaacttcgccggatcagacaattggactaagcccttgtcgttgacccattggacaggttctgagcccgccataatggccttaaagaccttcttagcaatcttacttgagatggtttcatctgaaatcatcttgatcatcccagctaagttagttggcgttaagtcagtcgctaacaaatcaactttatgctcgttcaagtacgcgttaacgtccccttgcaagtagtttgaagctaatttaggatccgcaccttcagcaacggttgcatcaaagaagtcagacatttccttagtttgggtcaacacacccgcatcataagcagttaaaccaaattcattgatgtaacgttcacgccgcgaaccaggcatttctggaatggtcttcttaacggatgcaatccagtcatcatcgatatcgactgctggaatatcaggttctgggaagtaacggtaatcatcgctaccttccttgacccgcatcaagatcgtttggcccgttgtttcatcaaaacgccgcgtttcttgttggatcttgccacccgccatgagaacttgttgttggcgttgctcttcatattctaacgacttgcgcacgtagttgaaggagttcaagttcttcatttcggtcttcacaccatacttgtcggaaccggccggccgaattgaaatgttaacatcgacccgcattgaaccttcttccatcttaacgtccgaaacgcccgtaaattggatccgttgccgcaacgcttcacagtaagcataagcttcttctggggaggcaatgtcaggcttagaaacaatttcaattagcggcgtcccttgccggttcaaatcgacataggaatagtcgttttcatgggtgtttttcccggcatcttcttcaatatgcatctcttcgataccgatttttttctttttaccatcaacttcgatttcaatccaaccatcatgcgcaattggtttttcatgttgcgtaatttggtaggccttcgggttatccgggtaaaaatagttcttccggtcaaagtacgtgtgatgttcgatttcagcatgtaaagccgttgctgctttaatcccagcttcgaccacgcccttgttaggcgttggcaatacccccggatacccccagtcgatcacgttcgtgttggcatttggttcggaaccaaattgcacgggtgaaggactaaagatttttgagttcgtttttaattcaacgtggacttccaaaccaatcgtggttacaaaattcattagttagcacctccgactttcggggtttgcttgtaaacttgcgttgcttgttcaaaggcatagcccgctcgatacattgtgctttcatcaaacgccttaccaattaattgcaagccaactggtaaaccgtctgcaaacccagctggtactgacattcctggtaacccagccaagttgactggaatcgtcaagacatcgttcatatacatcgtaattggatcagataattcgtcacccaacttaaaggctggcgttggtgcaactggtcccataatcaaatcgtagtcttcaaagaccttattaaagtcattgataatcatcgtccgaacttgaccagctttgtggaagtacgcatcgtaataaccagctgacaaggagaaggtccctaacataatccggcgcttaacttcatcaccaaagccctcggaacgactacggacatagacatcttccaaattcttaacatcgtcagcccggaaaccgtaacgaatcccgtcaaaccgttgtaagtttgaagaagcttctgaagatgcaatgatgtagtaagcagccacaccatagcgactgtttggtaaggagacttcttcaaccgtagcacctaagtcttcaaactgcttgactgcttgttgaatgacttcacgaactttagggtcgatcccctcgcccatgtattcttttggtaacccgatcttcatacccttgatatcacccgtcaaaccggccgtaaagtctggtacagtttgtttggatgacgtagtatcatgcacatcgttacctgcaatcatattcaaagcggccgcgttatccttgaccgtccgtgtcattgggccaatttgatctaatgaagatccaaaggcaatcagcccccagcgcgagacccgaccgtacgttggtttcatgccgacaattccgttaaatgatgatggttgccgaatcgaaccacccgtatcagaaccgagtgccactggcacttgtccagaagccactgcgacagctgagccacctgaagacccaccgggcactcgactgatgtcccaaggattacgagtgacatggaacgccgacgtttcagttgaccctcccatggcaaattcatccatgttggtcttaccaacgatcaaagcgttgcttgctaatagtttgtcaaccaccgtggcattatagaccggcacgaagttttccaacattttggaagccgccgtcgtcgttaggcccttcgtcacaatattatccttgactgccatcggaatcccagcaaaaacgttgttcgcgtcgatgccatcctgatccaaagcagccgcctgttgtaaggcctgttcttcatttaaattcaagaacgcccctagcttagggtcaacctgattcatattcgcaaaagtggccttcgctagttccgtagcactgatcttcttggctaccaagtcagcgtgcagactagttagatcttggtcgaaataagtcattattcaccgtccccactttcatcaataattgctggcactttgatcaagccattggccgtttctggggcattcttcagcaatgcttcccggagtgcttcatcactcttaactgccacgtcttcacgtagcgtattcgtatgatcactcatccgtgacgtaacgggtacacccgtggtatcaactgtgcttaattcttcgaacatgccgataattttttctagttgcggtgtgaacatcgctaattggtctggtgtaaactccaatttggctaagctcgccacgtgttgcacttgttcggcattaattcgttcttcagccatcagatttccttctttctcaaatcttactcaatattattgtttaatcgtcgccctggtcactaaagacatgggtgtaatacgaactacccttcgccgttctggctaagaagctttgaatgtcaccattggcactcttaaccgtaatttcaaccggtacaccagatggcaagtaccgtttagcagccgttgctaagtactgcgtgaaactgatgatttccgtttcgctgtagaacttagtcgtgatgttgacacttaatttactcaacgatttgtccttgtaatgagcattcgccgttacgccagacaagttcgggaagaaattctgcacgtgggacttaaactgactaaagtccgactcatcattactattcgcacctgagttctttgactcagaggtcgctgggaagacataattcttccaattcaacgacgtccagtttgagatcgaagtggagccgttcttagagaccgcgtaggcaatcatgtcgcccccaactaaactatcattcgaagactgcttatagagtgccaagacaatcggcacattcttcaaagctgagcgttgccgcaaccgttgtaagacagtattcgccatcttcttaccttgcgccgttaactcagtcgttgagatgtccgtttcgtatgttgccccatattcgaccttagtataataatcgaccgagttcattcccaagccaatcgtgcccccgccaagcgataacttactaccattttgaaccatataatcttgttcttcaagctgttgtaagtaaatcggattccgagtattcggatccttcttaccgttattctctgggttcaagccctccgaattgctgcttgatttccgtccgagccaattttcaactgtcgatgagctcaaatactgcccttcttgaaagacatacttactcgttggaaagacctttttagacacgtccaataagccactttcgaagctcttcaaattcatgacgttatcattttgcgaaacgaccacgcctcgcgacttactcgtccgataacggccatttttgatgacgccttgatagaactcactatcagcagttccagtggtggtcgttgttttcgttccggtcgttgtggtgctactactagtcgacccaaaggacgaattctttaaattaccgcaggcggctagaacaatggcagctactgccactaagccaatcgtgcgtatgcgtttaacattcacgcttgtgcatcctccctcattgtttcgctgaaccgggcttcatcccatacagtaatgtccagctgctgtgctttttgcaacttgcttccggcatcgctacctgcaatcacgagatccgtctttttagagacgcttcccgtaaccgtggcgccgtgagcttgtagccattgagtcgcatctggcctcgtaaagctttccagcttaccagttaacacgacccgcttgcctgcaaaccaactgttactatcttctgccacggtggcactagggccttgataagtggtattcacgttgactgcttgcaattcgcggatgagtgtatgaacttcgtcgctctcaaaatattgaaccactgcgttcgcaatcacatcgcccatcgaatcgatcgccgcaatctcttcttggctagctgccatcaacgcctcaatcgtcccaaaatgctgcgcgattaaccgcgccactttagcaccaacgtgccgaataccaagaccgaacaataaccgttcaagtgaattatcacggctacggtcaattgctgtcaagagcttttcagcagatttatcttttattttatctaatgttaacagttgtgccttagttaatcggtacaaaccagcaacgtcactaaccagccgatttgcatagagttgcgcaatgattcgtggtcccaagccatcgatattcatggcattgcgagaggcaaaatgaaccagcccttcttggacttgtgctggacatttcgggttaatacaccgtaaagccacttcgtcttccaaatgaaccagcggcgccccacaagacggacacgtggttggaataactaatggttgcgcatccttgggtcgtttggctaaatcaaccgatgaaatttccggaataatatcgccagccttgtgtagcaagaccgtatcaccgatgcggacatctttggccgccacgtaatcgggattgtgtaacgaagcccgcgcaaccgtcgtcccagctagttgaacgggttccataaccgcagttggcgtaacgactcctgtacggccaacggtccattcaacatcctttaaaagggtcggctgctcatcaggtggaaacttaaaggcaatcgcccatcgtggcaccttgactgtcgctcctagtgagcgttgcagcggtaacgggttagctttgatcacgatgccatcaatgccatatgctaattctggccgttcattttgataatggtcaatgtaactaaagacatcggccatcgaatgggccaccttaaagtcaggattgatggcaaaaccaagatctgcgaactccgttaacatgtcactctgcgtacgggcggttaacggttcgtagtcggcaatgttatacataaacgtgctgagctgtcgttccgccacgactcgtgaatctagctgccgtaacgtaccggccgcagcattgcgtggattcgcaaagactggttctcccgctgcttctcggcgttcattcaaggcagcaaacgctgccttaggcatataacattccccacgtacatcgatcgtcagtggtcgggtcaaccgttgtggaatcgacttgattgtcttaatattagccgtaatatcttcgccaaccgtaccgttaccccgcgtggacccttgaacgagcaccccatcttcgtaacgtaacgacagcgctaaaccatcaattttcaactcacaattataatcgactggatgaccaacgttttgttccaagcgatcaacaaactcttgtaactcagcttgtgaaaagacgtcgcccaatgacaacatcggaatctcatgggtcactttatcaaagcctgctttaaccgttccaccaactaattgcgtcggtgaatccggtgtaacgagctgtggaaaagtttgttcgagttcgaccaaccgttcatacttttgatcatacacactatcttcaacgttcggcgcatcttcgtcatagtactgccgacgccattcatttaacgtttgccgtaaagcagccgcttcatcagccgcctgctcaaccgtcattatgttgggtttgtccgccatcagccagtcctcctaactagtcctgtactttttggatcggtgcaaatgcggctaataaccgcttgattccttcagatttgaaagcaatgtctagttcagcatcttcaccagcaccggagaccttcacgaccgttccggttccccacttacgatgcttgactttatcaccgatcgaccaactattcttgtcagcacccgtgccactagccttcttgaccgtggcccgcgtccccactggattctttttatatgaaggtgtaaaagcacgccgttcacgatccgcaccaaatggaactttaggaccagtgctacttgcaccatccaacgtattttcatttttgagtaattctggttcgatttcttcaacgaaacgggaagccggattattctgccgccgaccgtaaagcatccgtgagtatgcattggtcaagtacagcttcttctcagcccgcgtaatcccaacgtatgctaaccgccgttcttcttccagctcgtcttcatccatcattgcccgggacagtgggaagataccttcttccatcccaatcaagaaaacaaccggaaattctagccccttcgctgcatgtaacgtcatcagcgtcacggcttggggttcttcctcaacgttatccacatccgaaaccagtgctaaatccgctaagaagtccacgaatttgtcactatcttcatcttcaggttgataactatcatcgaattgtttggtgacagacaagaattcttcaatgttttcgatacgggcttgtgcctctaacgatttcgttgccttagcatctttcaacgccttcatgtaacccgtgcggtcaagaatctcttgtgttaaatccgtcacggataagtattcccgcatagcgcgcaattcattcatcgtcgctgcaaacttcgctaaagcacccttcgctcgtgctgaaatgccattagccatatcaacattgctagctgcttccaacatggaataacccgcttcatccgcgaacaaccgcaatttttcaacactcgtttgaccaatgccgcgcttaggttcattaacgacccgttcaaagttcattgaatcttgatcgttcactgccaaagtcaagtaggataagacgtcccgaatttctttacggtcatagaacttattaccaccgaccattgtataggggatgttcgccttaacgagtgactcttccattacccgggattgtgcgttcgtccgataaaggatcgcaaaatcgccgtagtccattttgtcctgctgcatgctttcttgaatcttggcaatgacaaagtgagtttcatcactttcactctgaccacgataataagaaatcttgtcacccggttcattctcagtccataatttcttcggccgccgcgttgaattattgttaataactgcattagccgccgacaaaattgtctttgtcgaacgatagttttgctccaacatcaccgtgtcagcttgcggataatccttttcgaaatcgagaatattttccatgttggcaccccgccaaccatagatggattgatccgcatccccaactacacacaaatttttatatttgtcagctaacaagttgactaacgtatactgtgcgttattagtatcttgatattcatccacgtgaatataatggaatttgttttggtaccacgccagcgtttctggattctgcttgaataattgaatcgtcagcatgatcagatcatcaaagtcaacggcttgatcagccgctaattcacgttggtattgcaaataaacgtctgccacgacactctcaaagggactggcagccgattctttatacatctccggcgtttgtaagtcatttttcgcatttgaaattgcggataagattgaccgtggatcaaattttttcgaatcgatattttgttccgtcaagattcgtttgactaaggtccgttgctcgctagtgccggcgattgtgaacgctcggttatacccgatttgttcaatgtcacgtcgtaaaattcggacacacagggcatggaacgttgagacccagacctcctgcgccgattcacctaacagcttaccaacccgttcacgcatttcgcgtgcggccttgttcgtaaacgtaatcgctaaaacattccaggggttgaccccttgctcttcaattaaataagctacccggtgcgtcaatacacgggtcttccccgagcccgcaccggccataattagtagcggtccttctgtgtctaaaacggcttcttgctgcttgtcattcattcctgccaataggctttctttcgacacgctgttcgccaccctttctaaaaatcagtcaccaaacattatagcaaattttggccgtgattgctgtactttaaggtcagcatctcatacaaaaatcgcggtttttccattgtcagtgacacctatgttaattttacaacttctactattcacgggaaacgaattgacggcaatattgcgtaactttaagtaattttgagactccctcaatttctaaccaaaatacccgccacgccaatctcaacgattccccctcagataaccgtatctcgccatttggctggcttctccccaaccgctaaaaaaatccaattcacaaaatgaattggatttcgaactttatttattcacgacggttacccataatagctggtcacccggtgcgaacagtacgattagtttaaccgtaataatccgtaaaactaggttctgatcatacactactcagcttcaggttcattatcagccggcgtcgtttgcccaaactgccaaatacttgtgtcttcgatctgttcgagtgcttctttaacacttggtgcttcgactagcacgtggccagcgactggtgcccggtgcgcttgtaacaacgttcggtgatagaaattaaagaaccagttcgtcttaatctgccactgcgtgcgaatgccactctcctgagccggtgtaaagtaagcagcaaccacgggcatcaactgcttgactggcattaacggcagtcccgcaattgctcgcaagtgttgttctgccatactaatattcgtagcacgttcgaagacataacccgcctgatgcatcgcagggacaatccgcttcacgtataaattaccactcttcgttaagaagaaggcaacttcaaagacacccgtataactcaagttatcactaatttcctttgtgatccgcagcatttcgtcattcacagctgaatcaatttgagctggcacaatcgaggcaactagctcatgattacgataccggttttcaacggttgggaagaaagctgtcgtatcaccactcttagcgccaaaaacggagagttccttatcatatggaatcaatgactctaacaagtatgtgccccaatccaacagatcagccgccttgacaatatccgtctgcgtcttaatgaccagttgccgattttgacccaagcccttttgaatcggcttcaaaatactaggatatccaattgacccgatcgattgatagacatcatccaaactgacaattgtcgctgacggtgctacattcaagttaagttggctgaaaaacgcccgttccaaagagcggtcctgtgtaatctcaagcgcatcggcgccttgtggaacccgggtatgggccgccaaaaaattaatgaccgacgcatcaatggtttccgactcgtaagtcaccatatcacaacgttctgcgaagttctgtaactgttgttgatcattgagggccccgacaacgcgaaaatctgccagttccatggtctcagtattttcgttatcgccgtataccccgacattgatgccagcattacgcgcggcaattactaatccaacaccattagtactacttccaataatgccaagcgtaccacctgggtttaaaatcgagttgtccacttcagtccctactttcctatgctttaaataattataatctgattattgaattattttaacgctcattatcctgtaacaatcatacttgctgacacgcacagttgcaagtttatcactgcttttttcggcgagcattgcgtcgcttaactcgcttgagccaaaagccaccggagatgtagcgtggttcatacgcgatcacaaacgcattgggcgccgcgtctttaatcaggccatacagccgccgttcgttcttccgtggggccaaaatttctagttctagccgctcaccttctagaccataagcagcgtgttgtgtgaccccaaagccattttcacggagcactcccggtaacgacgacttgggatcaggtaaaatgactgaaatcattgtataccctaacgctaatcgatcttcaattaccatcccaacatacaccccgacaccgtaacctaacgcgtatacgactaaattgatcggattattgagacgatttaagaccaatgataatcctagcacataaatcgtaatctcaatgacacttgcaaaagctgcaaaataccgataaccccgcattacaagcaaaaaacgtacggtgtttaacgtaatgtaagcaaagttgatgatgaaaataaggactagcatccccatgtcaatgtgcatcacaatcccccgctttcttaacttaagcctgggtgtcctccgatgcaaagtgcacccggtcaccatcaaatgacgtaatctgtgctagtgattctaaacggacaccccgatcagcaatcagttgatgacccgtttggaagactttttcaatcacaataccgacacccgcaatttttacgtgcgctttatcacagatttcaaacatcccttgaaccgcctgaccattggccaaaaagtcgtcaattaacaagacttggtcatccgcctgtaagaacttcttggcaatcgagatgtggttagacgtcttcttcgtgtaagaataaacttcggctgtatataaatcatcaattaacgtgactgatttgtgcttacgtgcgaacacaacgggcacgtgcattgctaaccccgccatgactgccggcgcaattcctgatgattcaaccgtcaagattttcgttacacccgcatcttgaaacaagtgggcaaattccgttcccatggcaaacatcaggtcgggatcaacttggtgattcaaaaagccgtccactttcaatacttcaccgggaagtacccggccatctttcaaaatgcgttcttcaagttctcgcatagtaccctcctagaattataagcgacattgaaatactgctattaatttcattactttctatcataccgttgtaagtcatatttttgaataatattaattaatttttgtgcataacttggatcagtcgcatatccagccgtctgcaatgcttgcgcagctgtctgataatcagttgccttaatcaccgcagcgtagtgctgagaatcccaagtcgttccgtacgccaatttcttggcatgatcgaccagcgaagcgtgccagctatcataaacggcgaagcgccgtttgaccgtatgataggccccgtcataatattcctgcgtcgtcatgagccgtcccgacgtggacttaaccccaaacaaattattattctccgtcgcattggtactttgtccccaatccgattccaaaatcgcctgacttagcgtgatactagccagcacgtggtattgctgatcaagctgttgcgcagctggtactagctttttaataaatgccgcatgcgttgttgtaggtgctgtcgccgtaacccgcgacttaaccgcccaattatgctgaatataccaaaccatccccaccatcgccgccaacactaataagatattgacccactgaaggcggcccttcttcacaaataattgtgactttgtccgttgcttccggcgcgattttcgccgcttacccgccatcatagccgcctcctttctggtaattaccttacagattacacctgttcatttatcatgaattaggattaaaacatgctggtttcttagttcaaaagctgccagcttaggccaactgtaaaaagtgcgagttagtgtaaacgtgtttagattaagactcgtatttgagatgacgcgggttgggcgttagctcaaatcgacatcggctgcgttccagtaattgtcacccggccccgaaagtcagcataagacgcgcacgtgctgacgaataagaatccaactaaccaacatgttttaattctaagtaagcctaaatcgcaatgagcatcggtcatattacactctattttaccgacttttgaattaattttacatgattattgggcgccaattccttatttttttgctaaaatgtaagtggtcacattcgattaatcctaggaggaacctataatgtcgaaaacttatcgctgggccattgttggccttggtaacatcgcgcacagtttcgttaaatattttgatcaacctgacggagaaatctacgccgtttgctcacgttcgcaggaaaaagctaacgcctttgctgccgaacacaacattcccaaagcttatggtaatttagacgagctactggctgatgaacaagtcgacatcgtttacgtggcaacgccccataattatcacattgacacgattttacccgccttacgtgctggcaaacacgtcctcagtgaaaaggccatcacaatgtctagtacccaactcgcaatcgccaaggaagtggctgctagcaaccaccttatcttagcggaagcgatgaccctgtatcacatgccattatacgagaagctccatgattttgcggcagaacgtcatcttggtgatctgaaaatgatccaagctagctttggtagttttaaagaaccagacccaactaatcgcttctttaatcccgaccttgccggcggtgctttactggacattggtgtctatgccctagccttcgtggaagaattcttgactgctaaaccatacattacaggaacaaccatgcaccgattcagcagtggcgtcgatgaatcttcgacaatcacgttacgaaacgccaatgatgaactggccaccgttgccttaacgttccgagctaaaatgcctaaacgcggtatcgtcgcgtatgagaatggttactttaccgttgatacctatccacgtgccgacagtgccactttcaccgacagcgaaggccatactgaaaccatcacagccggcgatagcactaacgccatgaattacgaaattgctgacatgcaaaaaatggttgctggcgaattacacaacacgagtcttgctaaaacgactgacgttatggatatcatgactgccgctcgtgcacaatgggacttccgctatccatttgaaaactagttataaataacatctttatgtaaattaaaaaagcttagataccgtgtgttttttcacacgatatctaagctttttttacccccgtgaaataccattgaaaaaccccaagccataaaatcagaaagccagcttggactcgctgggaaaaatactgcttagtatcaacttggttagttggcgctttctcaaagccatactcatttattgaaggactagttaaaaatcagtcctaagcccatgaaaacgataaatgaaagacaaatcaacgttgcgtttttaattgaaatcgtgaaagtttctcgtttgacctgtttgtgcaagaagacccgcgtatttttccaaactggaataatactgagcaacgttagtaaactaaactttggtagcacacccatcaagaccgcaatcaccagacaagcataaccagcaacgtaactccatgcaaatacctgaagcatcaccggtttgccaaggtaatacaaaatcgtgtgtcggcctaacgcaatgtcctcgtccatatcacaaatattattagctaacataatgttagaaattgcaaaaatggccagacctgacgcaattaaaacagccagcgttgactgccaagtaatggctgccgtgtcatacgtattaataaagacggcaatccagaagatcataaagcccatcgtaaagcccgagaaaaattcgccaaacgggccttgtgaaattggcttcggtccgccagcgtaaaagtaaccgaccgcatatgaatatagccccatccacaacaacggcaaccccgtttgtgttactaaccatagtccgataatcaatgagattccggctaaaccaaacgtaatcgtccgggcctgaccaatggaaatctggttaacaccgaccacattagtctcttgcaaaaattcttgattgtcgtcattacgtggcgcgtgtaggaagtcttggtaattatcattcgcattagtcgccatgtgaaaaagtgaagatgcaatgaaaaatagcaataaataaccaagatgtaactgatgataattataataggcgtacatactccccaaaacgaacggtaacacgctcgcaattaatgatttaatttcaacaaattcaagaaacacttttggtttcaatgatttacaccatccttttgtttgacaacgaaacaagttatttgtacctttaatatagattgtattttagaatgtgactggctgcaagtgttggcgtcaaaacgtcccggagccatctctcaaataaagcggggtattttgattatgatgcaaaccatttggcaaccggaaagtcttgtcgcaaaggagctagcagcgctgaagccgtatctagctactaacgtaaaaattgataacgccgccattaatgaccgcgtacacgacttactcgctgcgggtggtaagtttttacgcccgggcttcttttacttgtttagtcaatttggaccggatcataacacggcccggttacgtgctggcgcagcggctatggaactactacacgtggcgacactgattcacgatgatgtaattgatgaatcgccagaacgccgccatgtgacaacgatccaccaagactacggtcaacgtaatgctatttacgccggtgatctgctgtttacctgctatttcgatcaagtcctgattgctgccaagacagctgacgacgttaaaatcaatactgcggcgatgcgagccatcctccaaggcgaactggatcaaatggcacataacttcgatccgacgaccacggtcgatgactacttagcaattgctcgtggcaaaacggcccgtctgttcagcctcagttgtgaacaaggtgcccacttcgcgggtgccgacgcaagcgtcgttaaactagcgcaacagattggtgaaaggatggggttagcctaccagatgttagatgacgtccttgactacgccggtgatgaggccttaactcaaaagccggtgcttaatgacttacgggacggcgtttattcactgccacttatctacgccctgaccgctgaaccacaattggccgaacaattaccccaacccggcgaccacatcagtaatgaacagctactgacaattcgcgatcaggtcattgctttggggggcgttacccaggcacaacaattggctactcactataccaaaaccgcactgaacctaatcgatcagctaccaactggtgaaacacaacaaactttacgccggctagtgactgaattactggttcgcaaccattaatacacaaattaaatcagcgcgtcaaaataacctattactctgacgcgctgatttttcagctacaaccattactcaccctacaccgccgcgatttagtcaaaattgttatccattccgccgaaataaatagtattatagtgtttgtataaaaattgtaataacggggctatttttactaggaggggtttcatgaaaaagattgttaattggttgctggggagcgtactaatgatcgcagcggtcacaatgctaagttcagtatctgcgaatgccagcacttactatcatcgcacgccaacgcgggcaacggctagaaaggcctattatacgaccgataccaaatcacatacctttagggctaatggtaattataatcgttggacattcagggccaatcatgatttgaagaactatcgcaacaccgtctggacaacgactcagcaaactgatattatcatgcacggcaaaaaggttcgttactactgggttcacaatagcaagaatggggccactggctggatttggagtggctacttaaagccacttaaagccaaagctgccaccccatccgaagcaacactcgtctccagaatgcgcgtgtccaaaaaggctcagcaaatcgtgacggtcattcaaaatggctcatccacggccactcttaaactttggcaaaaaaccaatcgcggctggaagaatacactaacttccgcaagtcgcatcggggccgctggcatcggcaattctcacgaaggcagcagtaccacacccaaaggcgtttatcacttaagcttcgcatttggtaaagctgccagtgcaagaactagtggtatggcctatcgacagatcaaccggaaatcttactggattgaagatccacatgaccggcaatataacacttggcagaaccgaaactgggccaataataagaacgagcatctgatcgattacacgaaggccgcgccccacaatcagtatcaattagcgattgtgatggacaatcacggtcagcataatggctcgggcttctttattcacgtcaagaatcaatgggcaacggctggttgcgtctcaatcaattacaatgatgtacggaccttactcagccgcttaggcacgaaagcctacgtggtcgacgttcagaatcgggcacaattacaaaattactaacaggttaaatcataacctggcgattaattgcatataaaaaggacttggtcacagcgaccaagtcctttttacgctctaaatcggcggtgtaatcagtaatggtcatcatgaccactacattcgtaggctgaatacccattcagcgcagtaattaaaagtctgtttcacaagcccaaggtgcacgtgaggactgctatcaaccggattaccgatcattgttcgcatcatcacgcccttgatccaaatcataaaggcgtttaaaccgcggtgcgttcgcatacaattcgctcggcgtaccggccatatcgaattgaccatcttccaagaagcgaacttggtcgacatggttgaccccggccaaatggtgcgtgacccacagaatcgtcttatcatgcaagacccggaacaccgtggtcagcaaatgggcctcggtaatcggatcaagactaactgtcggttcatctaaaatgatgatgggcgcatcttgtaataagatgcgggctagcgcgagccgttgtcgttcgccaccagaaaagcgcgcaccgccctcttctacaactgtctcgtaaccatcggggagcgtgtcgatcaagggcgctaactcgactgctgctagtgcggctttaacttgttcgtcagtcgcttgcaagttacccatccgcacattgttcataatcgtggtattgaacaagtacggctgctgatccaagacgccgaataactgggcgcgctcattttgtaaccgtgtgatgggcacatcattcaattgaaccgtcccactatccggtgtcaggtcacctaaaatcagcttgagcaaggtactctttcccgttccggaaggtcctagcagggctaacttttcaccggcttttaaagtcagattcaaaccgtcaaaaatcgcgtgaccaccttccgcatatttaaagtcaaggtccgcaatacgcaatacttgaaatggctccgttaagactgtctgatcgtgttcatcttcaggcgtggtgtctaaggcgttgactcgtttgattgaccgttgataacttggccactcactaacaccctgactaacagactgcatggcatcgaccaacgggaatacggagaggacaaacgccgcaatccaattggaactagccgcattcgttgtccagtaaaaactactccagatcaagagcgccaaacaaatcaccccgaaaatgatctgaatcgtaaaatctcgccaccactgaaagcgatggtcctgtttacgaagtgccgcaattgcttcgataggctgggtttgccgctcatagaaatccgtttgacgtccggcaatcaaccaatcaccgagccccattaccgaatcagtcagctgcgtataaaagccctgttgaatctgacgactgcgtgattcacgagcaccattcagtaagaccgaccatagcggcattaccacaacgaccaatcctaacatcaacaacatcaatagcccgaaccaccagctaaagtagcccagaccaatcacaatcactagcgtcatcaaccaggcaatcaccgttggaaaaacggtccgtaaatataaattttcaatatggtcaatatcgtcagctaaaatgctcaggacatcaccagtctggaaattttggcgaatcgctacggcgtgcttggcgacggattggtacagtttcttacgaaaatctgacacgatccgtagcacccagttatgactcgtaattcgctccgcatagcgaaaggcaggccgaccaatcccaaacgctctcgttagaacgattggcacataaatcatcagaatattatacgggtgtcgtgcggctttactgatcaagtagcccgagttgaacatcagcgctgaaccacagaagaatgtcattagacccaaaaacagcgtcagggctagtaactttttatacttgcgcaaatacggcatgacccaagtatcatttttaaaagttgccaaaaaatctttcattagatcgcacctaccatttcatcacgtaaccgaacgtacgccccgtcatgcgcggccaattccgtcggtgtcccttgttcaacgatttccccatgatccatcactaacacgtaatccatctgattaatccagtgtaaccggtgagtcgcaaagaaaactaagtgattatcaagtacaggtaaaatcgtcgttttcagttccgcttcagtttcaatatccaagtgggcagttggttcatcaaataacagaactcgccgcgagtcgtcaagaaaggcccgcgccaaagcaatccgttgcgcctgaccaccactgacaccacgggagccttcaccaatcgccgtatccaaccccgctggtaacgttgcaatccaggccgttaatccagcgttttcagcagctcgttcaatcgcttgacgtgaagcgtctggctgataaaaagcgatattctctgctaacgttgcatggaacagatatgggttttgcggaatgtagaaaaagctctgctgccaggcgtcttggctcaaatgcgagactgtttgcccgttgacttgaattttaccctgatcagcgaccggggttagaaagccacctaacaaattgatcaaagttgatttgccggagccagatgccccaataatcccgatccgttggtaaccatgcacatcaatattaatgtgttttaaggccagctgatcatcatcatacttaaaatcaacgtcatgtaagcttaacgtactatcactttgccattgcacaggctgagtaccgagctgttgacgttcagttggcaccggcaaagctagcatcttctggacatccgcaaacgcattcttgccatttaaagtggcatgataatcattagcaaatgttcgtaatggcaagaaatagtctggcgataagaccaaaataaccaacgctggtagcaacgtaatcgtgccgttaatcaaaccaaaaccaaggaagaccgcgacaaccgcaatcgataaggtcgtgaagaaatccaaggcgaaagtcgataacatcgcaatcttgatgaccgccatcgtttgcttacgataaccttcactaacctgataaacgttgtcagcgtaccgtttgctcagtcctaactgcttcaaggtcggtaaaccgcgcagtgtatcaacgaagtgattagacatccgttgatagcccacgtactgcttatccgctttagcttgagcggcatagcccaaaataatcataaatagaataattaatggaaaaattgccagtagaaaaagggcctcacgccagcgcaaccacgcgatgtaaattaaaatgatccacgggataaccatcatgtcgattactttaatcacaaccaacattaagtatgtctgaactttatcgataccttcaagcgctgtcgtcaccacgttaccagtcccagtcttagctacataacttgggccgagttggtataacttctgcatcactttacgccgcaagtcacccgtcgtctgttcgactaacgggtacatcacacgatttttaatgacgaccagtaactgccgtccgacccaagctaatgcgaaccatagcatgggctgactgatcgacgctaatgaatgcaagtgccacagtccaacaatcgccactgatagatagtaggcctgaaagacaatacaaataccctcgacgatggccaataaccctaaaatcgtggctgctcggcgcatccctggtagtttaaataatgccggatcaaacacattcgatcactccctacttaaaatgaacggggtcgcaccctggcacttggccaaggtcgcgaccccgttggtgctgttaaattaattgtaccaccgcaccagtgatactgtcgtcatctgcatttgaattacgatgccaaccgtttatagaagacccagtaactccaaataaagtagatcaacataatcggtaataccgataatgagattacagtcatcagatgcaacgtatatggtgaattagacgcatctttaatcagaatgctgtatgcagaattgttcgccaccatgacacgtgggaatagtccattgaacaggagcacgaccacgtcgatcagtgagagaccactgctaataaatgagagccattcatgatttccataaacaccccaagttgccaagaccgtcaaagccactaaggcgaccactaaaatcgtggttgagattggtttcttggtaaagaaatcggtgttaaagaacagcagaattgcgaagacaacttcaccggcaaacaggacccagtataacggtttggcccactgaagcgcccgttcacgcaacgtcccggtcgtcttcagacgaataaagtttaacccgtgcaaatagcagagtaacgttacggcaaccccaccaacgattgagaacaagttcacgtaatcggtgaagtgggcagtcatatcgccattggcattgattggcatccctttgaccaaagcagtaaacatcatcccaaataggaaggcagcaaagaaactacctagggctgcggcccattcccagaaattccggccggcgtcactttccatccggcttctaaattcaaatgagacccctcgcataatgagggccactagaatcaacaataagataagatagaatccggagaataaggaagcataccacattgggaacgacgcaaacatcgccccaccagcagtgatcaaccacacttcattggcatcccaatgtgggccaatcgtatgaatcacaacatcgcgctcagcgcgtgtttgggctaagctcttaatcgtcatcccaaccccgaagtcaaaaccttcaaggaagaagaaaccactaaatagaacgcccaccagaataaaccataagaattgtagattactcatgactgaacgcctccttaccataaggatcgtacggtgcgtcatcgctagcttgtaacaaatcatcagggccttggtgtaaggcacgccgtgataagacgatcatgacaatgcctaagccactgaacaagcagaagtacacgatgttagagttcagcaacgaagcgacactaacatttggtgaaacggcatctgcaatcgtcagtaaaccataaacaacccatggataacgacctaattcagtaatcagccacccggccgtgtttgcggcgaatggtaagaacgtacagattcctagtacccacaggaaccagcgctgccgctcaatcagcgttgactttgcacggttgaagtatagaccgataatggcaatcagtgcgaagagcccaccagctaccgtcatgacccggaagctccagaaaagcgtctttgttggcacgtagtagttcatgtccttaccaaatttcttgtcatacttggcatgaagttccttgttaagggtattttgtcccttcacattaccggacaacttatgatagcttaaaatatccaacacatacgggatttcaatcgaccagttggccttatggttcttagtatccatcccttcaataactgcccatgaagctggcgagccggaatccttatataagccttccgttgcggcaaacttcatcggttgttctttaatgatgtaacgcgtctgtaaatctcccattccaatcacaccgatggaagcaaccaggccaacgattaaactgaccttgatcgatttgcggaagaacgtgacgtttttctttttgagtaacgcaaacgccgccatcccagcaaccacaaatgagccggtaacaaacgccccaaacaacacatgtggtaattcataccagagctgttcgttcttgacgactgctgcaaagctcgtcatctgtgcacgaccagtcttggtattgatcatgaaaccaactggattttgcatgaaactgttcgctgctaaaatccacatcgcggaaatcatcgtcccaatcgacgttagccagataaacgcacagtggagcttggcattaaaccgatcccaaccaaacatccataacccaataaacgtggattccataaagaaggcaactaacgcttcaatcgctagtggcgccccaaaaatgtcacccataaaccgtgaataatcagaccagttcatcccaaattggaattcttgtataatccctgtcacgacaccaacggcaaagctaagtaagaaaatgcggccccaaaattgtgccatgtgcttgtacatgatgtcttttttgacaacatacaccgtttccatgatggcaacaaccaaggctaagccgattgataatggcacaaagaagaaatgaaacaccgtggtcatcgcgaactgaaagcgcgccaaggataaaatacttaatccgagattcataatggtccccccctttattaatttattccctacgaaagcggaaacactttattcacctttcataatagcaagtgataagtgaaatttcaatcaatctcaacttttattcccaaaatagtcaaagccgctaattttcaaggccactattagtacgcttattcgtttgtaagttcacattttgcaatctggcatctgctggtaaaatcacgcgtgactcccgcgaataactgagcttgtcgcatcataaaaatcaatcatcgtactcaatcagttaacaaattagttcatacaataaacaactgatgccgttattaaaaaagtacctcatttaacaagtttagcccgcgaaaacgcaaacaagcctgggttgtcgtgctatattttaaaacgtgcaatagaataaaacgttacgaggagtaaatataatgaaaaggaattcacaacaatcaaccaccgttgattattataaaatgttcaaagatggcaaacattgggtttacgcggggattaccattgcggggctcggtagtacgttaatgctgacgactaacgccttagcagcaacggctacccccgttagtgccacgaccacttctgcggccaacgccccagctagcgttgccagtcaactcagccaagccgccggggcaacggcaaccgagtcaaccacgacaagtagcatgactactggtgaagacagtaataccacgtcaaataccgacagcagcgctaccactgacaccaatcaaattacgactagtactaacgctactgagactagcgcgactgaacaagccacaagtgcagcgtcagctaccgaccaagctagtgaggttgctaacagtgcgagtggcacagtaactagtcagacgaccagcgctactaattcgacggcagccaataccataagtggtaacgaacaggccgctagctcagcgacgagtgacgctactcaagtcacggatatggtgacagccacgactaaatcaacgaccgattcagctattgattcaactgatgatacgagtaccaacaccaattcgaccgctgcggcaacgccaactagtgtggcgacgaccagcgcggctagtgccgcgacaagtgacagcggtcatggcttaatctacgaaaccaacgacacgactggcaatcaaaagagtacggtcaccattacacaaagtggcccttacagtgtgacctggaaaaaagttactacctctgataagacggacaccaccacggtcacgttagatgccagtgatattgtggccgtcgttaatacgatcaaggacttagcaaatcaagcagcgaccccgtctggaaaagaacaattagcagcagccaaagccaaactgacgacaattcttgacgagttgaaagagctccccacagatatcgccagcacgatcgtgggtaatgtactctacccaatcgtcttcacgggaactggctcagaagccctatctaatttacgtactgaaatgaaccagcaccgctatgacatctccaatacgtggaccggcctcgatccagtcgcttatgctgctgaccgggctgcggccgaagaatattacccgacaacggttacttggtgggataacgttaccaaagaaacctggaccctgcctgaatacaatgacccgacgcagtctgtccgtgcttactatattcaaaatggtgattccaccaagaccgtcatcatcggccaaggttggacggaacatgttgattggatcggctacgtttcaaaaatttggtatgacatgggttataacgtcctcatgccgagtcaacgtgggcagttcctaagtgacggtgataacttaacgtttggttatcaggacaagtatgactggctgaattgggttaagatggtcgacgaacgcaatggcgccgacagtcaagtcgtcttttatggtcaatcattaggtgccgacaccgtgttagaagcagcctcagttcctggactttcaaaatccgttaaagcagttgtgtcggacgccgggtacgcaaccttaccagaactaggtagttcgctatacaacaaagccatcaccgccgtttcaaacgcacttcaatccattggtctgccagccatcacgagcctgcccttcttatcctatgataaaatcgtggccgcgatgaacgctcgtttgatcaaggaacaaggtttcagtgtcgatgacttatcagcaaccgatgcagctagcaaaatcactatcccgttactcttgatccacacgcaagacgacgccttcattccatatactcaatcattggaattagcggccgccaatcattctgccaaccaagaagtttggatcttaccagggactgtcggtggtcacgctgcggctaataacgcgatcctacaataccgccaacacttgttagctttcttaacaccattgctatccgtagcggatgctgaagatgaagcagttgatgttgatcaagtaacggataatcgtaatcagggagcggctgacaacggtacaacgaccgattccacagcacaggacaatgttaccgatgaaacgacggctgacgaggccatcagcgaccatcaaactatcgtggataacacgaccactgacactaccaacataactagtgatacaacaccagacacgaccaatcatgcgaaacctaatgatgattcaacgactagttacgttgacttgaacgacacggataacgcagtggataatgattccgacacggcggttgacgcaacacgtgcgacgaccactgtgaaccagacaagcactatcgatcagagcagcgtgattaagggccaagtcagtgattcaattatggtcagttcaaacgccacgactaacactgactggttagttaatcacgatgacagcggttcggccgtcacggctagtctgcttcaagattatagtgaccaggaagcaagtgtgacgacgccagccacggtatctgccacaacaactaatactgacagtgccgacttagttgccgtctcctcaccagcatccaaagccacaactgagctcccgcagaccgacgaaacaactcagtcatggctcgcaacgctgggtaccagtctcttagccctagcaacggggatttgggcccaagttcggcgacgttttaattagtgaacttttacctgttacgtccactggtgtgttatccttaataaaactatcgtgcgaaaagaggcatcatcatggatattggaacacaagtgacgttcattttggaaggccagaattataccgggaccattgcgaaaagttacactaattcgtatttaatcacctttacaagtcctgatccagccatcgttgataagtatcacaacaaagtaattattagtcagaaacaagttcaagccgttaaatagcgatttaaaacagccacccttgaaattcaggagatttcaagggtggctgttttaaatttgaattgattcaagctagctgtcactttagcgacttattttttaaaacgtagtaatggtgtcccgatcagtggtgtgagaattccagctaaaatcgcttccggaatcccattcgaggccacgatcgttaacaagtacggcattagtttgctcaaattaacttgataaaagccggctgcttgatgactatagagtagcccaatcaaacctaagactagaatcgtgttcgttaatgccccggccacgcccgccagcgtcatccccaacactttttgatgccgcttctgaaaccaaataaagacccaaccggctatcaaaccgacgagaatccggggtatcaccgaaatcaatggattggtaaatacgattggtgctaagggactcgtcggtgcgacgaacgcccgtatccacgcaataattccccatgcgcccccaataattgccccatcacgcggtcccaagaccacggcggccaggataaccgtcacgtgaattgtcgtaatactcaatcctggtaatggaatgtacccaaaaaacggaacaatattctgaatgatcacgattgccattagtaccgctaatacactgatatgataggcgtttgaacgtctctgcatcatcagccacctcaactctctttaccttatgaattatgcgcttaattatagcatatcccaaagcttagtagccgcgaaaagaatgggtgcttacccgccccggtaagcacccactattaattacgattttgattctttggcacgtaaccctgctcgaatgcgggagtgccgataactataggcaaagtaaatcacgatgccaataaccagccaaataccaaacatatgccacgtaaatgcctgcaaattaagcatcaggtagacacatgcgaggaacgagacaactggtaacactggataaaatggtactttaaatgaactattgatttgttgtagcgtttcgtgtcgacgcaggaagacaacaccgatagacaccatagcgaatgcaaatagcgttccaatattgactaactccgcaattttatctaatggaatcacagccgcaaatacactggcaataatgccaaaaatccaagtactcttaactggcactttggtatggggactgaccgtccgaaagactttcggtaacaacccatcccggctaatcgcaaacagtaaccgggtcccaccatataacatgacaatcaaaacggtcgtcataccgacaacggcacccagtgacacaatccccgccgcccagttttgatgaatgacggctaaggcatacgccacgggatcacccacgttaagcttactgtaatgcacgaccccgaccagaacggcggccattgccacgtataaaatcgatgctacgactaacgaaccgacaattccgattggcatattacgcttaggatttttcacttcttctgaagcagtcgacaccgcatcaaacccaatatacgcgtagaatgctaacgacgcgcctttgaccagtccgctaacaccatggggcatgaacggatgataattggcaggtttcacaaagaaaattgccacgccaatgaaaagaacaatcactagaatcttaacgattaccataattgaattgacccgtgttgactcttgtagcccaccgaccaataacagtgagacggccaaaaccacgacaaaagcaattaagttgaatccagcaccactgacaccggcagtaccagctgcggcggtcagaaatgttggtagttttaggccaaagccgctcattaaattctgaaagtacgatgaccaacttaccgccaccgaagataccgcgaataaatattctgagatcagagaccaaccaagaatccacgctaagaattccccaaaaacggtataaacgtaagtataggcactccccgccaagggaatggttgaagaaaattcagcgtaacataatgcggccaacgaacacacgaccgcagcaatcacaaatgagagcatggcagccggaccggcatacttagcggcgataattccgggtgtgataaaaatcccagaacccacgattgcgccaacacccatcatggttaaactaaatgcgctcaacgtcttttcgaggccacccttattaaaattagctggattgactgattttttaaccagcaatcgttgtgatgctttcatccggtacgcctcctaatcaaaatcttaataatgcaacgttgttaattctattaatttttgtgcaattagtcaagtaaatctaacaatttcaatcaattcctaattgaatcctttcaaggcagcactttacagcattggttattttaaacaaatttattaataatccataagattcactaattttaatttaaccgcattattatgggttacgacttaaccaacttttgttaatcgccgctgaaaaccgagctgaccagtcccacagtcatacgtcccgacttaaatttgtttctatcatattcatctgtttaaatgcaatcgccacaagcttgtatcttcaagcactcctttcgcaaaaaattaaggtcggtcagctgaaagaattcgactgatcgaccttaattttgacctttaacatattttaatcgggttcaactcaagcagttttgatcaaaaaagaagcatcccgtctctttcaaccggaatacttctaaataaactttaaatatattggatcaaggtcatcaagactggcacaaccacgatgaacaacacggtactcgttgtcacgatgttagtggcgtattccacgtcaccatgtgcttcgttagccaagattggtaacacggctagcattggcgttgctgattgaacaatcaaggtttgcgatgctaaggttgggaaacttgcaccgagattgccagcaaccatcaagacaagaatcatgatgattggtgacaagatgaagcgaccaatcaacgcaacaatcgtatcacggtcaaagcgaatactcttcagaccagcgtcggccaacacgatcccgatataaatcaaggaaagtggtgttactaagtttccaacgtaagtcaacgttgaactgacaaatgataccttcatgattggaatatttagcagtaagaaaattaatgcaactaagaaaccaaccaatggcattggaatgactttcttccaatcaatcttgttatgcgtcttttccttggatttcgtcgggtcgtcgtttgaaatcaagaagaccccaaatgcccatgtcgaaacggtattaacaatatagtaaacaaggaaatacgtcatactcttgtcaccgaacaacgcaatgttcaaaggtaacccaatgaaaatcgtgttggcgttgacgatcgcattgatgaaaatccccttacgacctggacggacccgcataattttaactagcgcaaaggcaatcaagtagccaataatcacggctagaaatgcatatgccaagtaacctgcaaatgatcctaattgcccacgagttagtcggctcagcacagatacgaaaatcgatgctggcaaagcgatatttttgataaatttggaaattgttccagcaaacttatcatcaaaccaacctgctcgtcgtaggacgaaacctaatatcatgatcaaaacgacaactaagacgctttgaattgaattccataaaactcccatgtgctcttataccctcttacaattctcttattttaccgacactatttgctgatggcccggtattctgggacccacttcatatcagcaaccgcttgtttagcatctgcaattggttctttgttgagcttctgatcgataacactttgtgccacgacttcagctaatttttgtgaaaattcagtaattttcgcaactggtggcaatactgcggcacccggcttcgacgtatcaacgattccacctaatgcgtggcaggctgctgacaaggtttcagcgttcagcaccttggctgttgaagcaatcaaaccaaatcctaaaccagggtacatcaaggcgttgtttccttgaccaatttggtaagtgacacctttgtattcaacatcatcagctggaatcccagtcgcaactaaggcccggccgtcagtccatttgattaagtcttccgctttagcttccgctaacttggttgggttagaaagtgggaagatgattggccgttccgtgtgcgccgccatttccttaatgatgctttcagtaaaggtaccaggctgagtcgatgtcccaatcataacggttgggtgaacggctttaacaacggcttccaagttggttaattcgtcggcgttgctaaattcactccgtttgcgcgtgaaggctttttgggctggggttaaaccttccgtgtcgtcaaatagtaaaccttgcttatcaacagcgtagaagtgttgtttagcttcttcttctgttaaaccagcttgcatcaattcatccaagatttggttggcaattcccataccggccgttccggcaccaaatgataagattttttggtccttgatgctttcctttgaaatgttcaatgcgcctaagataccagctaaaacaaccatcccggttccttggatatcatcgttaaaggttgcgatttgatccttgtacttgtccaagattacttgcgcattgtcgcgaccgaaatcttcaaagtgtaacaatgaatctgggaataattgttgttcagcagcaacgaacttgtcgatcacatcatagtattgttcgccggaaacacgcttgtgccggttaccaagatacaatggatcatctaataatttctggttgtttgttccagcatcgatgctaactggcagtacttgtgatgggtcaatgccggcagcggcggtgtaaaccattaatttaccaatggcaatatcaacaccgttaacaccccagtcacccataccaagaataccttcagcatccgtaacaacgactaaccgaatatcacggccgtccgctgcattcttcaaagttgcttcaatatcttcaggtgcatctacggaaacaaaggccgcattttgtgggtccaagaacaattcattatattgttcaatggaatcggcaacgacgggatcataaacgattggcataaattcaaccacgtgttcatccatcaaatggaagaatagtgtccggttttcgttaaagagattcattaagaaaatccgttgttccaaacgactgggcttgctcttgaattgggcataagcttgtgtcgcctgttcatcaattgtttgaaccttgcttggtaacgtccccgtcaaaccaagtgcttgacgttcctctttggtaaaggcagtgcctttatttaagaatgggttatttaaaatttcacttgcagtttttgtcattactgcggcctcctaattaatttacattttcatcaattttcattgctaggaaaaacgtcctatcaatttacaagtaatactgtaacgccagtaaaatgttatagtcaaaactatgatatgatataaatatattaaataaggtcgctacaaaagctgatttagaaaggaataaaaatgaacacaaaagacttagcttatttcgatgaattaatttctcaaaaaaatttttcaaaagttgcgaaaacattcggtgtgagccaaccaactgtgaccaccgcaatcaaacgcctggagtctgaattcggggcaccactcgtgattcgtgaccgtgttaaaaatacgttacacgtcactgctagtggggcgcaacttgctgaacacgctaaaatcgttttacatgagttacgcctcgcccaccaagaaatcgacaatctatcccaaaatcgactgattttaggattaccgccaattattgaaaaccattattttccaaaaatcggtgcccgattggccgcggaagggctattagccggtctcgaaaccattgaggggggctcgatttggctacgtaacgctgtgcgggacggtcgcgttgacatgaccctacttggttcggtggagccgctcgcttaccaaacgttgattgccgaagaatttgaccgtcagcccttctgtatctacgtgtccaaacaacatccgttagcacaacgtaaacgggtctactttaacgaactacgacgtgaaaaatttgttttctttaatagtaatttcatccataatacggccttcaacaaactcacgcgccggaatcactttcgccccaacatcgtctttcgttccaacgatacccacgttttaatgaaattgattggtgaaaatgtcggcatcggtttctttaccaaaatcgtcgatcactaccgtactgacgtcgtacgactggacttgatggacattgaaccccctgaattcatcacaagcatcgtctaccgaacaacccatattctgacccccgtgcagcaacagctactgaccattttgcacgaaacattagcggttgacactgatcagaccgattaagcaaaactgcaccacccttacagaatagtctgtgagggtggtgcagttttcgtaatcaagacaaattgcgatatatccaaatgaaacaatcgtgaagacacgtcaatctcaaagtaaaagttgaaccactcaaggaatcgtgctgttcacttagacagatggctcagtcgcgacgtttaaatcttcattttaagtaattgatcaataaaccgttgttcatcagtggttggtaagtacccagcccgtgtgaccaccgagatattgaagctgaccggcaattgatctttgatttccaaacatacgacgccatcatccgctttaaccacatcacgaaccagtaagctaatgcccaagttggctttaactaaggctttgacccatgagatatcgggggtccggtagataacttctggatgtaccccggcaaagtcacaataggctcggaaggcttgtgggtgcacgtatttgccatctaatccaatgaactgtgcctgaccgagatccttaaaactaacggcggcttgtttcgccaaactattttgaggactcacgataatactgaatggccgtgcccctaagtgaaccgcacgaactgtcggcaaatcaaatggtaagtaggaccctaataacgcgatgttgatctcaccatgcactaacttacgcaatagctcatctgagcccgtttccgttatttttaactgttgcagtaacccgttctgaagtaacttttccgcaatttgagggaaatataaagtgccaataattggtggtaagccaaaacgaatatcagtctgtaacgtactctgaatttcgcgatgagcaagttgcaaactggcctggatctggcgtgcattcttgtaaagcagctgaccggcccgggtaatatttgtctgttgatggcgacggtcttgaatcaccaatttgactgcaaactctttttccaaccgatgaattgcttgagtcactgccggttgtgagaccgcaaactgcttggcgaccatcgtataattttggcaatcaactaacgcccgaaaataatctaaatcacgtgtattcatccgcgctcaccaaattccttcatgtacatcgccgcaatcttttgctgtagctcagccactgaatgccgccgtgaacgcgcgcaatccttggcttcgcggtgacataataagcaacgacgcttcggcagtcccaaatccgtccgcgacagcgcgcgctgtgaacccgcttgtaagatatcaatatcatataagcgacctaacggatcgtgttcttcaaacgcgaccgccagccgtttgctagtcgcaaagtcagtcgtcagaatcaagaaccgctcattacccgccggatgattccaatcagctgccaccgtgtatgtcgacaactcagcttcaaaccgctggacaccggccaaaaacaaccgtcgtagtgcagcgttattcttaatcggtcccggaatattcaacttgatcgccgcaatcgtggcccgggggttagtcgctgtcaactgttgctgatacgcgacccgttgatcacgggctgctagcattgccgtgattgtttgcggttcaccggttgtaaaaatcgtcgccatgcttgtcactttcttcctatatgtttgttatatttccagcttaaccgaaattagtcgatttttaaactaatttctttggtctctaactacagcccaaatcaaaaatagcccacgcaccgattactcaagcgcatggactattgatttgggttagtcaaaataacttattgtaaatatttgaacatttgttgtccggcttgacggccaaagatcaccgtttcagcgattgagttaccaccaatccggttattgccgtggagaccgccgaccacttcaccggctgcaaacaggccggcaatcggtcgttcgtcctgattcaacacttgggttgctggattaatggcaatccccccccatcgtgtagtgaacagctggcgcaatgtgaattgagtagaacggtcccgccgcaatatcgcgatccatcccagtcgtccggttaaaggccgcatcattatggttagcgactgcctgattccagtcagccaccgtctgtttaagcgtcgcagcgtctaagcctgtcgcagtcgccagtgtttccaagtcagtcccagtctttaccaggccaatgtgatcatagaattcaaccgctttgacccggtcacgaataccgcggtcaaagatcaagtaggcaccagtaccacccagttggtcgatagcggccgtcacgttcttacgcgtgtcgagttcattgacgaaacgagccccctggttatcgaccaaaatcgcaccttcgccccgaaccgcttcaccgattaaataagcatgatctgtatcttgttggaccgtcggatgaacttggacttggtccatatcaaccaacttagccccaatagcttgtgccaacagaatcccatctccagtcgcgcccggctgattggtcgtctgatagtttttaagatcatcacgatactggcctaacaaggtcttattcgcaccgaagccaccggttgctaacaagacggctccagccgtaatcgtgacagctccatctggggttgttgccttgaccccactaattttgccggcttcgacgactagttcatcgactttgacatctgtgaagagtggtaactggtcagccgccacttgtttcaacaactcagtgactaagaaaccaccaatgggagccatggaacttggccgatgggtccgcatcacactcatcccaccagtaatcgtcaaatcatccaacttaatgccgtggtctgctaaccagtcaattgcgagcgcactgtgttccgtgaagaatttcaacagtgcttggttattcataccgccaccacctttaagggtttcgccgtagaaatcgccaaaactatcaacaatatggtgatgcaattggacgttcgtctccgccgcattcataccggatgaagcccgggtggtgttaccaccgattttcgacattttttctaaaataaccgggttcaggcccaattcatgtgcctggattgccgcagtcaaacccgcgccccccgatccaataatcactacgtcatagttcggttttagatccgctaaggcggttggtgtaaatgtaaacttttcagccattgattgccacttctcctctcaattcgtccggggtattccccaggatggaaccaaaatctcatttattattgtcgttaactggacacgggccaccattccaagtctaggaacaatgacccgtgccaccttgatccacgttaacggttcaacgccgatcaatacttattttagcttaatcatcaatattcgtcatatccagtggaaccatccattcatcgaattgttccgcggttactttgccagacttgatggctgcttcacgcaatgtcgtccccgctttttcagctgcttgagcaatcatcgcactatcatgatagccaatatgtggtgacaatgccgtaaccgtcatcaaggaactgtcgactaactctgccatccggtcttggttgaccgtcaaaccagcaatcattcggtcagtgaagccggtaatcgttccagctaacaattcagcagattcaaggaaggcatcaatcaaaacggtcttgtaaacgttcatttcaaaattaccttggctagaagctaaatcgacgaccacgtcattccccataactcgtaccgctgccatagtgatggcttcagcttgggttgggttaactttcccaggcatgattgatgagccgggttcgttagccggaatgtttaattcgtcataaccggcccgtggaccgcttgccaagaaccgcacatcattggcaatcttcatcaaatcggctgctagggtcttgatggccccgtgaaccacgtttaagccagaatgatgggccaaaccatagaacttattggaatcagccgtaaattcaatcccatacaatttgctcatcgccgcagcaatattttcagcaaaatgaggggcagcatttagaccagtcccaacggcggtcccacccattgcaagctcgcctaacgttggattcaactgttttaagtaggcaatatcatgttcaatcgcactggcccaaccactcacttcttggccaaaagttaatggcgttgcatcttgaagatgggtccggccgatctttactacccgccagtacttcttttgtttgatcttcaattccgctaataagtgttccgctgcggcaatcagcttatccacggcaactgcggccgtaatgttcatcgccgttgggaagatatcgttagagctttgaccatggttaacatcgtcgttcggcaagatttcaatatcaggattgatcttaccagccatgtgtgcgaccacttcattaacgttcatattcgtttgcgtccccgaaccagtttggtaaacaaccagcggaaagtccttacgcaaatcttcatcgtcgagcgctaataacttatcaatggcagccacgattaaatcagctttttcagcagtcattgcttcaacttctttattcgcaatcgctgcggcccgcttaatttgaagtaatgcccgaatcatttccaacggcatcttcgtaccagtcggaaagttatggcgactccgttctgtctgagcaccccataaggcgttcgcaggaattttaacttcgcctaaagtatctgattcaactcgatattctgtcatgttgataacctccaattaatgtgttggtaagcgcttactaagtgtgtgaaaaaaataacatttagtttataatcctagtttagcgcccccatatagctatagtcaaactcagttttagctataagtattagttatgaggtttatgtatcagtatattagcatacaaagattgcttagaatgagttctagataaaaatgtttattttttcacatgttcttatttattcctcttgcttaattttactcataattgtcactttttcttatttgtagacctaaatataccaaaccacaaaatatcgagtcatagttgaaaagagatgaaatcaggcaaatcaaaagaacgacgtatggttaactagtaaaacttttttatcaaattcggttgcaatcgagtaggaggtaattgattatttcaattaccgacctctcacaccaccgtacgtacggttccgtatacggcggttcaataatttaagcactctgtatttgctggagtgtcttggacaggtttattagtccaagacgctccagcttttgatttgtatacgtataggttagtgttttattatgggcaattcgccaatatcccttgcgggtattggcattagtcttggcctgttccggtgtcattcctagcttaattagctcacgatatcgggttttgattttcttccaccgtttccatatcaactgtctaatcctacttcgcaaccattggtccagttgttgaataaacgtcttcatcttgccaatcccatagtactgtagccatcctcgcattttctgtttaattttcttcatcaacattaaccaactaattccacgacttcgcccagtcattatcttaagggcttgtttgattcgctgtttcacgaccttgtgcggtcgtgcatatgccccattacggtctacaccgagcgtaaatcctagaaactttagtcggagtggtgagccaaccgtcgttttatgacagttaattgttagtttcaacttaatttcaagaaagattgtgacattgcgtaagactcgttctcccgctcgcttacttctggcataaatattacagtcatcggcatagcgcacaaatcggtggccccgctgggtcaatagcttgtccaactcgttgagataaatattggccagtagcggcgacaggttcccaccttgtggtgttcccttcgtcgtctttcgaaacagctcgccattcatgaccccgcttgttaggaagcgccgaattaggtggagtagccatggatcagttactcgttgtttgatgaagttcattagtaagtcgtggttaaccgtatcaaagtatgcctttaaatcgaggtctaccacatagtggtagccttgattgtagagttcggtgacactttgaatcgcgtcatgcgcactccgacctggtcggaatccatagctattgtcggaaaatacttgttcgtatatcggcgaaagcacctgtaccacagcttattggatcatacgatcaacaactgtaggtactcccagttttctggttgagccatcgagttttggtatctctacccgtctgactggttgcggccgatatattccattacgtaaactctctaggagttcttcccggttcttgtaaatatattcggccagttggtcaacggtcatgccgtcaattccagctacgcccttattcctccgaacacgcttaaacgctaggttcagattactacttgcaaggaaggacccggtctacaaattgaatgccatcctgcgccgtactttcaccgttagtagtacgatgcgccccaagatactctttgtcttccagactattcatcccttggcggtcagcttgttctgttttctgcaatcttcgcactaccaacacctccagtatcggtgagaattattattgttcagtccttcatctgccatacggcagattactatgacctcggctgactagtttactcctgtaaacccatatcggcgtccttgttgggagcttatccgacaggcctccccgggtaagaatgatagctttcataccatgcaaccgttggctttactaacttcgacttcaagtagtgtaggacttcagtttgtgaagcaacttcatccagtctaatcagccttgtagccacttcttgtacatcggttcggtattttgtcttaggcttccttcagactccgtctcacggcgaacgcccttgccctcaactcgtggttccgactactacggcccacagcggacttacaccgcctagttatcacccatgccgggcgcacttcaaaaaagaatccaattcataaatgaattggattctagatataacttcatcgacactggttgacagaagccccttattgatgctagccatggcatttcagaaaagcacaatgcctctttataaatccattgaaaatgccgcgacagacactaatcctggtattttcttagcgattcaaccatagtccaagtactaaaagaacaatcatgatacctaaaattttggcgtggttccaatacttaaacagcaagtcaataattgcaatcacaacaaatacaatcagcaccgacataaaatacaaccaaacattgccattaacactaactgtcacaacaaagccaataacggctagccatggtaaatatttatcaataaatagcttaaaatttgggtattgatccataattaatccaccctaaccaccttatatttctttacaaacgactgaatacgtgaagcctttttacgaatgtgtttcctagatttattcgtataaatatgaataactgttttatattgtactacatacttgttagcgcgcttatacgcccacgcagttaaataagtatttcctgcaggaaaatagctcccaaaaaatgtacccccgaacatccaaattgcttgtccgccatatttggacgcaagcgcctgtactacgtaagtcatgattgctgcagacccagacttctttaacttttttgttattttaacagtttttttgaattttttcctaagtttccattttcccttaggcttaggtgcaactctcttatacttggctgcctgtgcatgtatttcacctatactttctgaaaaaccatcaaaacttgaaaatacactaaatgagtttgaaagtatctcagatacttctgaagtaaaaaaaatgaaatctattttgaaaaaggctcgacagctggaagaaaaatcgacgttacgctatatccattatataatttgtattttagatgctcttatacacgttgatacgtacaattgcgatcaacttactaaccttgtcaaacctgtctggaacgaattgtctacggtaagtgtctggaatcatacagacctttttattattaataatttactatatatttttgacttccaaactgcactaagaattgggaaaaaaattattactaaacttaaccagtatggagataataatgttttactacaaaatgctatttattctaatttagcattcattaacatgaccaactccaatgcattcggtaaaagcataacaattaactatttacaaaaaagtatcgagttaaccaaacacgctcaccggtatgatttactattattgagtaagatccgtttagcaatggtattgcaacaatacgaaaaagcaaaaaaatgtgctcaatacttacgcgcatgggggctaatgacattgtcaatctggtctaccaagattttcctattcttgtaacctaaattcactaatactatcacttataacttcccccgatttattcacaaaaataaatttagcgtagtacaactgaatttaagttaaaacttgggattaaccgtcttagtttattatttttccccataaacctcgatgcgaacaagcgccacacatgttgttaatgacgaatttacaattgaagtgcaacaagtaagaaaaaaataaaaaagaactcatagcctgagtcctataaaatgaagtcaccacaacaatcatctaaaggagatcctaggctatgagtccgtacaaccatcttaccttaaaagaccgagaatgcatactgttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcatggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctagtaaccttggtggaccgcaaatctcggtatttattatctcagcgggttcccaaagtaaacgccaagaacgtcacacaagtgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacgggggaaccaatgagaataccaacggacttatccgtgagtatttccccaaaggaaccgacctagaccaactgactgatcaagatatcgacaagtttgtcagggatttaaatcaccaaccacgtaaggtcttaagctggaagagtccatttgaagttttcttcgggacaaagttgcgcttgatttgacaattcgtcatacaaaaaatgacctagctagcaatttgccaagcaaggtcatttttgtcatcaatatactttagtccttcaccgctttaatcgtatcaataatcgtgccatcgcgatattcaatcaaggcaacggtgcgatctgtaaattcaagtggttggggttggccgactttcttttcggctaattgttgtaattcttcaatcgtatagaccggcacgcctgggacatgactgagtgctttaactaggtcttgacgccgcgggttgattgcaatcccgtattccgtcacaacaacgtcaatggagtcccccggcgttacaacggttgttacttctggcacaatcgtcgctaaccgaccacggacaagtggtgcagagataatggtcagtttggccgtagccgcgtcttgatgtccaccaatggcgccacgaatcacgccatccgaaccggacatgacgttgacattgaagtgcgtatcaatttccaacgcactcagaatggcaacatccaattgatcaaccatcgctcctttattatcagggtcagcgtaccatgatgcgtcaatttcttgttgattaggattggcgtgcatcgatgctgccgcccctttgtcaaagtcttgaacatccatgactttatcaactaacccttcttcgagcaaatcagtggttggtttcgtaataccaccaagtgcaaacgatgctttgatttgattatcgagcattgcttgccgcaagtaccgagtgacagctaacgcagcaccgccggaaccagtttggaatgagaagccgtttttaaagtatggtgagttcacgatcacatcattaacggtctgggcaatcttcaattcctttgggtccttggtgaagcgcgtcgcacctgaaccaatcttgtcagggtcaccaacttggtcgacttgcacgacgtaatcgacttgtgtctgtttaattgaggccggtgtatttggataagccacaatattatcggtcaataagacaacttggttggcgtattgcgcatccatcagggcgtaacctaaggaaccaaagactgctttaccagccatcccgttcgcatttcctagtcggtcagcattcggcacacctagaaaggcgacatcaattttaatatcaccatgttcaatggcccgggcccgattaccatgagaacggaagattacggggttctttaaaccaccgtgtgaaacgaagtccccaagagagccccgcatccccgagctagtaatattcgtaatcgttccggccttaattgcttcgatcaccatatcgttcatcacgcccgttaaggaggatggcgccaaggtcaaatctttaataccggcatcaataatggcccgcatcacttgattgaagacgaaatccccattacgaaaatggtggtgaaatgaaatcgtcataccatctttgacagtggcttttaccacgtcagcaacggaatcaacgactttgttgtcccctgttgaaacgtgaactttgggggccacccgttgaatttcaggatgtccgatttcggttgactcaaaaccttggtaatttaacttcgtcattaattctgctggtaattcgcggtctacactatttttcaatgtaattgccctcctcgtcgagtaagttggaaactttggctaagctcatcacacgttgagcccgcaaaacaacgggccggtctaccatttggccattcatggaaataacaccagaacccttgatccgggcttcctcaatcgcggcgatgactttttgggccttaataacttcatccttggttggttcatagactgaattgaccattgcaatctgtcgagggttgaccaatgatttaccgtcaaatcctaattgatgaatatgccgcgtctcacggtagaagccatcgggatcggccatgtttgtaaagaccgtatcgaacgcggcgattccagcggcacgagcagcatgaagcaccatgttacgggcaaattccagttccgcgccatcaggataacggtgggtcttcatgtccgtcgtataatcttctgctgacaaggcgatcccaatcattcgatccgaggctgccgcgattgccggggcattaagcacgcccttagcgctttcaattgcagccatcaaatgagtcgtgccaactggtatcttaaattcagcttcagctgccgcgacatccttttccaacgtttggatcatggtagccgattcgacttttggcaaacggataacatcaatgccagccttgaccattgctttgacatcatcagcgtaatacttggtatccaaaccattgattcgaacgaccaattcagcgttgccataatcttgcgtttttaacgcttcgtaaaccagcacccgggccgcatccttttcagccattgagacggcatcttccaagtcaaacatgatcgagtctgcaccgtaaatcccggcatcctttaccatggctggattattaccaggtacaaacatcattgtccgccgtaagcgttcttcattttcagccattataatacctcccatgctggtgtcgtggtttctaacgcccgttgtgctgccgtaatggtccgcgctttaatgacgcagtccaacgcccctttatcaacagcgcgcaccttcacattatcgatattcaattgttgaagcgtcgtcgtgatcacgtgcttgatttgtgccccgaactgtttgataacatccgattcaaggtcgatttgaatgccgttgtctcccgccattaacataatttgaatatcagatgattccaaggttccggcgactgccgttgtcttaatttccatcaattttcattcctttctgaattcgcgcttgtaatgttgttaggttattttttataaactgggccgttgttgccggtaccagttggtttaactcagttaagttgccgctttgaatccgttgccgaacagtccgcgccgaaattggttgattagccaccgtcgttcgcgatatcactcgtacagcaactgccggtggtaattcacgctgcaaaactcggttataaatcgcagtcgtccgcgacgtcggttcactaccaacgaaccgggtcgtaatgtgcagtgctggtgcaagttgctgcttaaagatccgggcgtccaacgtcgtctgcgcttcaattgcgctcgccgctgaatccaagaagtaggctggaaaggtcgctgcactcacgagatagtcctgcccgctgacgacccgaacgttggccaaatcggctgttccttgttgaaccagcttaacgcgctcggccgtacggaatagactcgcatctgtcgcaacgacgaagacgtaaactaaatcactgaccgccgcggcttgttccactaaatagcggtgtccccgcgtaaacgggttcgcattcataacaatcgcgctgacacgctgttgtgcttggttgggaatcatcggcaactgtttgacaaaatccgtcatatccggtgcgccgttttctaatacggccgcttcatccgaatgagctaattctttaaagcctacgtgttgaaaactcgctgaatacttggccttggtaaataccatcatatgaaagatctgtgcttgaaacagccgattgaccagtgcactcacgatttgattaaaccgggcccccggctgactattcttattacagacacccacatatttaagcacgttgcccgctaacgatccggtcccaacaagttggccatcctcgatcaatcctaaggtcacatcaatatgttcaacctcttgcgggctaaaattagtaatccctaatgacgttaagaattgttgccactgggcatgctcgtgcggattatttaattgcatttcaacaacttgcgctgccatcagacaacctcctatgattaatgctgtgcttgcgcgtacgctgcaacggccgccgtcacgttcggtaccacttgtgaatcaaagacgctcggcacaatcgtcgtcgcagttgggttcgacacggtcttagccaaagcctgagccacttggatctgtaacgcattatcaacttgcttgaccccatttgtgagtaagcccttgaagagccccggaaaagccagaatattattgacctggtttggatactggctagaacccgttgcaatgactgtggccccagccttctcagctactgctggattgatttctggcactggattagcgagtgcaaagacgattggatcatgattcatcaagtggacggcccctgctgataagacgttggcgtctgacaagccaatgaagacgtcctggtcggccatgaccttcgccagtggttgcccctttagttgtgcaggtgttcccaactgtttggcaagatttcgttgataccggttgtaccgctgatcatccgctgtaacgaccccgtaaacatcgaccaaggtcagttgtttgacaccgaccgctgctaataaccgagctgtagctaacccggatgcgccgacgccgttgacaacgatgcgcatctgccgtaaggacttaccgactacgtgagcggcattgatcagtcccgccaacacgacaattgcggtgccttcctgatcgtcatgataaaccggaatatcaagctcatctttcaaggccgcttctagttcaaaacacttaggcgccgtaatatcttccagatgaatgcccgcaaatgagagcgacatgtttttgattgtcgccaccattgctggcacgctgacctgatttaacgccagcggaatcgcattaatccctgcgaggttcttgtataggagtgccttaccttctacgaccggcaaaccacccgcgggaccaatattgccgaggcccagtactgctgacccatccgtgatcaacgctactaatttaccactcatcgtgtattttgcctttaattccggatgcgccgcaatcagcttagaaatcaccgcaacaccaggtgtatatgctttacctaaatcagccttatcggtcactgcaaggtctgaatgaatgtccaaaacccccgtatgggcggcgtgcaactttaaaatctcatcttgttctaccatcaatatctgccttctcttctcaaaataataccgttcactttgttatccccagtgtacgaccatttttaaaaaatatcaaatttagattggatttttataatttttaaaaagtcaacttttctggtataataaacttaaaatattataaacgagttttaaaattttaaatcttaggttgataaagaggtcatcgatatggacgatatgaatcatcgccgcctgttgattggaattgcacatgattattacttatccaaaatcaacatcgctgaaatttcaaagaaataccaagtcagtcgttatctaatttcaaaatacttagacgaagccatggcaaccggcctagtcaaaattaacattaacacccccatcgaacgaaatagtgagctggaggctaaatttaagcatcgttttccaattgaacatatttatattatcaaagacgcggataccacgagtgacgatgaacgccacgtaatcgagtttgccgccgaaacaatccagcgccagattattcaaagtaacgtgattggggtggcatggggtggcactgtccttagcgtcatcgataattttcaaacgagcactcgtgacgacttactgttcacccagtttatgggtgataacctgaaaacgaacgcagcgaacggctcaacaccgttggttcaaaaagccgccgctaagttcggcgcacagtacgtcaccatcccggcaccactctacttgtttaatgatcaagcacaccaagcattggctcaagaaccagccattacaccggccatcagtaactttgaccgaatggacatgctatttgccggaattggcaccttagcatccattgactcgattcccgtctggcatcaacatcgccaagccattctgggtggcgctgatccgcaggcggtggtcggcctgttatacggtcggccatacgacatcaatggtcacattctgaacgccgaccatgacaaactctttggcgctaaaatgcccgccattctcaaagtgccgcgtcgttttggcatcatcaaaagtaagttcaagagcgaagccttacttggcgccctccgcggacaattactcactgacatcatcattgatgaagccgtcgcgaatcgggttctccaagaagatcaagccacaccactatccaaataatccgcttcttcgaaaacaggtaccaacgctgaccgttgccggcagcttggtacctgtttttatgcttaaaatcagactaccaaataccaatcactttcatccagagggcgccaatgccaccccaaacgactaggtagaagagacctaaaataaagtttaactgccaccattttccctgagtaacatacccagaaccgaagagaacactcgccgggccgttcgcataatgcgtcgtcgaagcgaagatcgaaccagtaaagccaagtatcagtgcagcaaaggttgctggcgctcccgcggaaaccgcgaccccaagtaaggcaccgtacattgcggaaacgtgggcagtcccactagcaaacaagtagtgactgtagaagtagaacaagacgagtgccgctaaaacaatgccccaactgaagcctttcaaggcaccaccaatcgcgccagacaaccatggaataaagccgagtttgttcaactcattagccatgaagatcaaaattgagaaccacaccaaggtattccaagcaccagtttcgtgtagcacgtcatctaccgatagaactccagcaacgagtagcaaggagacggccataaaggcaactaatgaagcttcgagaccgataaagctggataacatccataagactaaggctagcaagaagacgccgcccatgattttttctggaagactcatcttacccatctttgccagctcatcatccgcccattgcttggcattgggcgtatctttaatttctggtggatacattttataaattaaatatggcacaaccaataaacaaataagtcctgggacaatcccggctaagaaccattgcatccacgataacgtgatgtgtaaactcttggctaacgtgacagcaactaagttaggcgccatcgccgtcatgaacatcgtactggtgattaaatcaccatgaaattctgcgaacactaagaatgaaccgattttactttgtgtgccatccttgggatcagaaccaaacgtttcagctaacgactgaatgattggataaacaatcccaccagcacgggccgtattacttggcgttgcgggtgctgttactaaatcgacgccaatcagtgcgtatgccaaacccaacgttcgtttcccaaacagccgcacaaacaccaacgcgacacgtcgacctaaaccagtattgatgaaaccacgtgacataaaatacgccatcgcaatcatccataccgtactgctcccaaatccggcaaccgctgtatccataggcacgatgcccaataacacggttagtgtcaacccaatgattgcgaccccggcgattggtaacggccgcgtaatacaaccaataatggttgccacaaaaattgccagaatatgccatgcgttcatcgaaacactggctggtttgataggactacttaaccaaatgatcaggcccaccaataacggtgcaataaaatcacgatacttgaccttatttagtgtcatctcaattcctcctcatacttactcatcatttttatgatgccacattcatcatggtcagcatcttggctgcgaaatgttgcatccgggcacgctcatcatctgatagctcagcttcaatcactttttggagcccgttgcgattaataatggcgggtgaccccaagtacaaatcgttaatgccatattgaccagacaaagcggcggagacaatcaactcagcattttcatcgttcaaaattgctcggcagatttgcatcaaactaacggcgaccccatagaacgtggcccccttctgactaatgatttgaccacctttaccacgaacagcttgctcgatttcagctttgaactgatcatcgaccgttgtgaccgtctttaagggctgagcattgatcataatttcatcaaaattaacgatggaactatcaccatgttctccaagtaccgcagcatcaactgcagtggtggcaacattcaacttctgagccaaggcgacccgtaaccgcgccgtatccaaggaagtcccggtaccaatgacccgatgccgtggaaaaccggataaacgttgcgtcatcgaagtcaaaatatcgacgggattacttgagataacgaagcaaccattaaaaccactcgcaaccactggtttgacgatggattccagaatcttcgtattgcggttaatcaaatctaaacgactctcaccaggcttacgaggcacaccagccgtaatgacaacgatgtcagcatcacgcgcatccgcatattcaccggtatgaatgttggtcgcattcgtaaaggcggcaacatcttccaaatccttaacgtccccctctgcgtgcgttttaaccaagtcaacgataacgagttcatctagggcgcaattttggaccaatgaaaaggcaaatgatgaacccaccgagccatcaccaacaattacgactttgcgttgcttcttatccatgtcaatatccttctttcatcaaaaatgtgtgctgcacatgtggttccaactacttagttacttaactcacaagtattataacgcaaatgctttcatttttgctaattttttaaaaataaattatttttttgaaaaatttaaatataattgttgtttaaaacgcctgcgtagcagcatttaaaattattttgattgtgaactatttctaaagtgtcggcttgtgaaatcattttcgtaagcggttacaatcctgcgtttaaatttcctgattggcgtcaattcgaaacatctgcgcaagttacaaaactttttacccgccaaccgatcttgaaacagttaaaacctgattagcgtggtatattagaagtacgactcaaactagagaggactaatacattggataatgaaactttaaaagactatctcgcaaacaactcccaagttattaccatttttatggagaaagcaaccgattttctgaatcgaaaaaatgaggaccgggcgccagcacgccgctataacgatgctgaaatcgcctggcaagcggataagatgctcgatgatgtgattgccaatattcatgataaaatcgtcccccatacccgcgaacaaacaccggctgcctgggaacaatttctgagtgaaaacgacgtacttgatgatctggaactatcaatgacggaattgtcattcgaatcggaagactaaactagcagttcaaaataaagaaaggaccgtggaagatttaacttccacggtcctttttagaacaaacttatatcacatgacatcaacacaaccgaattataggcccaagtactacgaccgagtcagcccagcataaatcttatcaagattccacttcaacattgagtagtacgtatcacccggtttgcctttagctgccagcgaatcggtaaaaatcgtactagcaacggggattcccgtctcctgtgaaagcttattcatcgatttcggtgatacggatgattcgacaaacaaacttcgaacctgggttccttcaattttcttcaacgccgtccgcatctgagctggcgtgccttgcgattccgtatttacttcccaaatataagcagcgggcacatggtaggccgccgagaaatacttaaaggcgccttcggatgtcactaataatcgttgactcgtcgggatctgcttgaatttggtttgagcgctctcatgcagttttgttagttttgccacgtagcgatccgtattcttttgataaacagcggcgtgcttaggatccttggcctgcaacgtccggttgatgttcttgacatattgaatcccgttggcgagatctaaccaagcatgggggtccggctcattaacgttcgtcgttaaatatttgaccttaattcccttactggccgcaaaaacatcgtggtcaaagtcctttttggaagccgtcactaactttttaaaccagccattaccgccagtttcaaggtttaagccattataaaaaatcacgtcagcttcggcagttgccgcaatatcagtgggccgtggttcatactcatgcgggtcagtgccgcgcttcacaatactgtaattttggacgtactgcccacccacatttttcaccatatcatctagaatcgagttcgtacttacgacccggattttggcactagtggtcgtcgctttggcactttgctggcgttgattcagaaatactgccatcccggtaaccatcgcgatgactccaatcagtgcaattaatttcgttttcatgctgtcacccgtcgcgctgctgcttgccctttccaaagcgtcggcaacaaggcctgcttaggtgagatgatgaaagaaataccgaagaaaatagccgctactagcacgatggccggaccagaagcccagttcaacgtgtagctgagatataagcccaccactgaggacaagaccccaattaaggctgacagtccaagcatgactgccagtcgttctgtccatagaaaggccgtcgcagccggtgtaatcaacatcgcgaccactaaaatgatcccgacggtttgtagcgctgaaacggtcactagcgttaagaccagcattaacgcgtaatgtaacagttggaccttgagaccataagtcttcgcaaaggtcggatcaaatgacgtaatcagtaattccttgtagaagaagaccacgaataaaatcactagtcctaacacgaccgtcgtcgtcatcatatcagtatcactcacagcgagaatgttaccgaataagatgtggtgcaagttcgtcgaactttcagctaatgaaattaggataaaaccgagtgcgtaaaacgcactgaagacaatcccaattgaggtgtcagtcttaatcttactacggctcgcaacgaatccgatcaagctagcggctagaattccaaaaaccgaagcaccaattaggacgttgataccgagcatataagctaccgcaacaccaggtaaaacggcatgcgagatggcatcgcccatcatcgacatgcctcgtaaaataataaagctaccaataattcctgacatgaccccgaccataatagccgtaattagcgcactttgtaagaaatcatacttccccaaagcagccataaaggtcgtaattgattgcatcatcgcgtttcctccttcgtaaacaggacggccgaaagatcagcactaaacgtccgttcaatgtttgcgggtgtgtagaccgcgtccacgggaccataatcaacgataccgtgatttaaaatcacgagatcatcaaagtagcgtgaaactttgttcaaatcatgatgcacgacaataatcattttgccggcatcacgccactgatgcaagatcgtcatgatagccgtctcactctgtaaatcaatgccgacgaaaggttcatcaagaataatgatatcggcttcttggactaaggctcgagccacaaagacccgttgtaattgtcctccagagagctgactaatttggcgctgtgctaaatcggctaactcaagttgctcaagtgcatcttggcaacgctgacgatccgccttgcttggttcgcggaaaagtccgagtttgccataggtcccagtcaaaacgacgtcaaaaacattgattggaaaggttaagtcgagatctttacgttgctcgacatatgcaatctgtttttgaaattgttttagcgcacgaccttcatattcgacggttcccgtttgggatttgatcagaccaagcattgctttgatcatcgttgattttcccgcaccgttgggaccaatgattccagtaattttgccggcgttaaagttaacggcaacatcagtaaagactggtgtgtcactgtatgccacggtgaggttttgtacttttaacatcacatttcctccgttcatcgcggtagtcggttttctacatcgtcataagcataactgataattaacgctaatgcaaataattgttaggtacagttaacttttttataatcggtattaaattttcgttcattctaatactatttatgcttaaccaaggcgttacaaccaacatactaaatgcttaatccagaacctactgaaacgactttcgatgccatcaccactaaaaagcactgaccactcatcaactaagcattgcaatcgtcatttaatttccattaatatttggtattaaaaaagtgtcgtcacctacaatcacgacactcattattaagctaatatatctgtctgcaacccaataaaaatcgtcaaaatcaacaaatcggccgagccacctaaactatagttatggtcgacaaagatctgattcaattcgcgtaaaaacgccattccagcttcactgcggctcccccctaaatcgaagtagcggtatgcttggtcgtggacccagtcaatgacgtgcgggtcgtgtgcccgttttaccagattggtatcgaccgtcgcctggacaatcgccatcagtgtgtctaataaccgctgattaatcgtgccacgactacgcctcaatgcgggtagtgccacttgcatcacggtcggataacccgcctcggcttcaccacgaattcccttgatgccatatgttaagtattgacgttctccagcagttaaggtcgttggatccttcgtgtttaaatcattaaaatcatttgccgttaaccccgccagcattgtgcgcacaatcgttgctaagtcgacgtcggggtgctgcaactgatacgccgccgctgtcactagcacgcccagtgagaacaccgcccctttatgggtattcacgcccttggtcgccgcaaacatggtttgttccgcttgaacaccaatgccccgaatttgcttgaacaaacccgtcaaatcgacagccgtatacgcgacgcccgccgctgcacaagcattaaagtagggggctagactcaaagcactatcaataaacataaaagcgttcatgtctggatgggggcccgccgacaacggatcgaccagcccgggcttagggttgaccgtcacttcgtataaaagcgctcgtagcgcatgattgacaattatcttcgtatccactatttctccaccatttcatccttagtctaacaacgatgatgtgcttgggtcactttcagtcctgatcaagcgtgaccacaaccaacactcagttaccattacttatatttccatcataactgatactagtcaatttttgtcatttttctttgtattcttttgtcgactgctgttcaagcatcttctgaacgtgtaagctagagctaatcaaagttattcctaaggaggaccttgtcatgatacctagtcagcattttcaatccaccccaaccgtccaatttgacttattaacatacatgattggtagttaccactacaactggcatccgcaaatcgaactcttatggttattgcaaggtaccgtcgaagtgaatgttgacgggacgcgccatcaattacacgcaaatgacctcatcttgatcaatgccaatcgcggccatgccacctttgccttgaccccagaatgtatcgcgctccgtttacatattctgcccgatttctacactagtcagggcatcgacctcagttcaggtgcttttctactcaacagcgtgacgacgccccaacaccgtgactaccaaacgattcgccaaattctggcacaactctatctaggattacatcagcaggactggccaatttttgacttgaacgccctgtactttcaattgacgaacctgctacatcacgatttctttgatactggaatcacgatgacttatccccaacccaagacgcagagttcactaaaccggatcattgattacattaaccaggcttacgatcgaccaattaccttaaacgaagcggcaaaaatcagtcactattcaccagcctatctctcacgcatcttcaaagcggaactcggcctgaatttttacgaatatctaacccgctgccgactacaacacgccatctacgatctggaaaacccaaccataagggtcgccgatctagccttagccaatgggtttcaggaggtcaagtccttcaatctaatgtttaagaagcattttggtcagacaccttccagttaccgtcaacatttgtcacacgggcaacgtcctgaatatgaccagttcaagcaaccgctcactcccacacaaactaccattgtccaaaagcaactcaagcactgggcccaactcacaagtactgatcaactcagtgcttgtgaaatttgcatgtataaactacattttcaagaatatcaggcactcaaacaaaagatcgcgcaattaaaaacattgcttaatcaataattaatggcataacaatttttgtgattacgaacaactgaacttaccgatattttgatcaagtattgggtcataccaaggtacgacggcatcactcgtcagaaggccttggtatttttttgtcatttttaaccggctacctgtccgcttaccatcactttcacaatccaatacctggcataactcggcgagtagcggttagttttgtatcatacagttacttacaatgtagctgtaaattgataggaggaaaccagcatggatacaatgacatacgactataccgaaccaacattatcaactaagggccaacggatgcgcgacattttggccgattatattgcgctcatcagtcatcgactaccagatgatgtgactgccaaactcgaagaactcagtaagatcgaagtcgatccactccaaaagctcgtgtacgacacgatgatggaaaaccaattacttgccaataaacttaaacgcccaagttgccaagataccggtgcgttacaattcttcattaagtgcggcgcgcagttcccactattaggcgaactcaatcaaattttgaaagacgccgtttatcgtgggacaaaaaaagcgccactccgacataatgctgttcagacatttgacgaatacaataccggtatgaatattggtgacggcatcccctcgatttttctgcaagttgatggtaatggcactgacatctcaatgtacgtgtacatggccggcggtggctgcacattacccgggactgccaaagtcctgatgcctggtgaaggttacgaaggcgtcgtccgtttcgtgatggatcgcatgacgagctacggcattaacgcttgcccacctttactcgtcggtgtcggcgtcgccacatcggttgaaacggctgcgcttaattctaaattagctttaatgcggcgcgtcgatagtgaaaatccaaacgctaatgctgccaaactcgaacacttattagaagacggcatcaatcacattggcctgggaccacaggggtttggcggtcaaaagtcagtaatgggtgtcaatgtcgagaataccgcccgacacccatcaacaattggcgtcgctgttagtaccggctgctggtcacaccggcgcggacttatcaactttgacgcagatctaaactatgacttaccactgaacaaaggagtcgaattatcatgaaaacttaccacttaaccaccccaatttctgatgacgatattaaggacattcgtatcggcgacatcgtctacttgaatggctcactaacaacctgtcgggacgttgcccatcggcggctcgttgaagaacaccgccccctacccgttaacgtgacagaccgagcaattctccacgctggcccgatcattaaagatctcggccatgacaagtacgaaatggtcgcagtcgggccaacgactagtatgcggatggaaaaatttgaagaagaattcgtaaaacaaacccgtgtcaaactaatcgttggtaaaggcggcatgggaccgggaaccgaacgggcctgcaagaaatatcacgccttacacctcgtctaccccgctggcaatgctgtttatgccgccctgcacgtcaataagattgttgatgcccagtggaaagacctcggaatgcccgaaacactctgggcgtgtgaggtcaaagacttcggtccgttaattgtctccatcgatacgaatggcgacaacttgtttgaaaagaacaaggtcatcttcaacgaacgtaaagaagctgagattaaaaaaatcaacgaacaagttaaattcattaaataaccgaccattaacagcctaagcggatcaccctgcttaggctgttggtctaaaggagtctttctcatgattagtatggatacacaatctactttaaaaacccaagctttagccgctctgagtaccgtgatcgatcctgaacttggtgtgaacattgttgacctcggtttgatctacgatgttgcttacgatgctgacctaaagctctgcaccgttaccatgacactgaccatcatgggctgtccactgacaggctatttgaatgaccatatcaaaagcgcattaatgaccgtcgcgggtatcgatcaggtactcatcaaccttgtctgggaaccggcctggtcgcttgataaaatgtcacgggcagcaaaaatgacattagggttgcattaattctaatttagaaatcgtgtccggattagcatcatttgctgactagtttcagcagtcaccgtgagacgattttaacgtttgactagaaaggtggtcgttttcgatgaccaaattacaatccgtcaactaccagcaacttacatgtccgctgataattggtttgattatttggctgagcgcgccatttcgtcccgcggggctcagtctattagcatggcacatgctggctctctttgttggcactatcattggttgcattacccagccgttacctattgccggtgtcgcaatcattggtctcacacttggtgtcttacttggtgtcttacttggtgttacctcgatgacggatgccatggccggctttggtgataacacggtttggatgattgcaatggcttacttcctatcgcgaggcttcgtaaaaacgggactagggcgacgagtcgcgctggtcttcgtcaaattatttggtaaaaagacccttggattagcctacgcgctgattggtgtcgatctcgtcactagtccggccacgcctagcaataccgcccgcgccggtggaatcgtcttcccaattattgaatctttagctaaagcatacggctctgacccacaaaacggtacgcaacgtaaggttggcagttttctcattatgtcagctttccatggtaatattgccaccagtggcctattcatgaccgcgatggcaccaaatctcgttgccgtggccttggcccaagcaatgcagattcacatcacatggatgggctggttactcgccgctctattacctggtcttatttgcttaattagcgttccagctattatttatcggctctatccgccagaaattaaggatacacccaacgcgcatgcgtgggctgccaacgaacttgagcagatgggggccatgactttggccgaaaaactcatgggcggtatttttatgttggccctctttctttggatctcagctagtctcactgggctagacgcgaccttagtggccttcatagccgtcactttgctcttattaaccggtgtattatccgttgacgacttattacatgaaactggggcttggaacacactcgtttggttttcaattcttatttttatggctggcaaactgaacagtcttggctttattccatggctttcacaaactatgggccaggccctgcaaggaatcagttggctatgggtcttggcagctttgatgctcgtttacttttacagccactacctgtttgccggcgccactgctcacgtctccgccatgtacggcgccttcttgggtgtggcaatttcagccggcgccccccccaatgctagcagccctactattaggctttgacggtgccattttcagttcgaccacccattacgccaacggtcccgcctcgattatgttcggatcaggttacataacgcagtccgaatggtggcgtctgaatctgtgccttggtggtttctatctattagtatgaggcgttggtggcacactctggatcaaacttttaggctattggtaaactagttgtttttcaactataccatttgacaggttcagacactcattcacgtatttcccgactccgggctgagtgcccatttctgggggaaggacgatctagccgagcaagtttacgcaaatcagaacttttgccggtgaccctaaactggctttttaaactcaagactggcatattttaatgcatgcttcatgaaaattaacgcgcacaatgtgaacttactcctgactaacgacttgatcatacaaacatcacgccctaaccaataacaatcggctttccaactattacttggaaagccgattgttaatctaccatgtaagtccatcagaacctggacgtcaaaagttctgatgctccctcaaattttcagatcccacccggctaaccgtcatgtgtcgaactgaagcatattgtaaacttacgtctaatcacgacaccgaccacaagtcacccatccaagtcgccaagtccgtgaccgctatgggatacaggtggggttgcccaaccgccgataagtagacccaggtcagcgctgtaccgtgcacttttttgtcgtgttgcatcactgcggccacggcttgcggcgctatcggcggtaattccgtgggcaaccctaccgccattaagcgtgccttgagcgtcgacgttaaactagtcggcgctaacccatgtgctgcaaacaaccgacaaacctgtactagaccaatcgctaccgcttccccatgcattagttgaccgtcagccaatagttcgactgcgtgaccaatcgtatgaccaaaattcaataattgccgctgaccctgttcatgttcatccgccataacgacgcgcgctttgaacgccacactagctgcaattaaatctggtgctgctggtaaaatcgctgccacactggtaatttgttgcaaggattgccaaaaatcaccgccaactaatgctgcgcacttaacgatttcgccataaccttctgcgagcatccgcggcggtaacgtcaccagaattgctggatcaatgacgactaaatctggttggtaaaaactgcccactaagtttttgccagttggtaagtcaatcgcggtcttaccgcccaccgaactatcgacttgcgctaataatgatgtcggtacttgaatcaaggcaataccgcgcatataaatcgaagcgacaaaccctgctaagtcaccaaccaccccgccaccaagagcgatgacaccgtcactgcggctaaaatgggcggcactcagctgatcgattaacgactggacttgtgaccaacttttgctcgcctcaccggctggaaccgtcatcacacgcaccttgaatccagccgccgtcagttcatcagttaccagcttcgcatagtacgggcccacattggtatccgttaccaccgctacttgacgggtacaccataccttagttaccaacgttcctagatgatgtaaactgtcaatcatgatcttgatctgatactgtttaactcgcgtcttgacttcaatgtttgtcataggcacatcctacgcccacgtttgcatcaggtcatgtaactggaaagcctgttgcgccatttttaagtacgtcgcgggttttaacgcttgcggcccatcggataaagcttgcgttggctggtcatgaatttcaacgatcatgccactggcgccagctgctacacctgccatcgccatcggggtcacgagttcccaggtaccgaccgcgtgactcggatcaacgatgactgggtaatgtgtcaacgattgcaagactggcactgcacctaagtcaaacgtgttgcgtgtgtacttattatcaaacgttcgaattccccgctccaaaagcatgatctgatgattaccaccagctgcaatgtattcagctgcattgagcacatcgtcgattgttgccgacattcctcgctttaatgcaaccggaatttgggtctgtccaacggctttaagcaacgagaaattttgcatattgcgtgcaccaatttgaaaaatatccgtgtatttcgccaccatcgccacgtgttcatcatccatcacttcggtaatcatatcaaggccatgtttatcagccgccgtccgtaagtattggagtcccgtctccccgaggccttggaagctgtaaggtgacgtccgtggcttgaatgctccgccacgaacaatcgtcgcaccaccctgcttggcaaccgcggccatctggtccacgtgttcagcgctttcgactgaacacgggccagccatcatgacgaattgattaccaccaatcacactgtgtggcgtcttaataatcgtatcttctgggtgaaagagacggctgctttggaccgctgcgggaactgccgtcaagattgattcactggctgcttgcacatccgcgggaagtgcttctggacgcaatccttgaattgcaattcgattattgtgcgtgaagatctcgtgatccgcaccaaattgactcactaactttgcctgcatagccgtagcggttgctggttttaatataataatcataataatttcctcctactaatcaattctcaaaagttaaggcctaagcctgcgccgtaatcggcggagtcgcttgaatactggctaacatatcttggcggacctgttgaactggcatctgcttaccagtccaaaactcaaaagccaaggcaccttgccaaatcaacatccccaaaccattatatgtggcgcacccctgctgacgcgctaagcgcaaaaaggtcgtttctagcggttggtaaatcacatcatagaccgtctgttgtgggactaattgctggataattgagattggtaatggcgttccagcagtcgtcatgccgatattggtcgcgttaatgatcaaattgctggtacgagcaacttgctgcatccgtacttggtcttcataggcacagagccggagtggtaccgaagtcgtggtactgagttgctccaaccagtgctgaacaccggcgtagcgttcgttgttgcgtttaaagaccgttacactcgcgacaccataatctaaagccgccgcaatgattgccttacctgcgcctcccgcgcctaaaaccatgacgtgcttatcaaccaagttcagaccttgatgtaagagatcctgaaaaactccagcgccgtccgtgctgtcaccaatcagcttgccagcttcattcttaatcgtattgaccgcttgaatccgttgcgctcgcactgtcaaaccatctagtagcggtacaacggtttgtttgaatggcattgaaaggttcacccccgcgatacccatgctacgaattccagcaagcgtaccagccaatccatccggtgccacatcaaacaccaagtagcgcgcatttagcccccagtagtcaaaactcaaattatgcattcgcggtgagcgactgtgccgcgcggggtgcgcgataaatccaaagagtgccgtttgtccatcaatcatgctttaactaacttcctttctaaatgactcgcaattgttgaccaagatccacgtgcgtttgttgatacgtccgcactaggtctgctaccgtgaactggttagcggctaatacttggtcggccgctccactggcgccaaagtggtccaagcctagtaccgccccatctaacccaacgtaacgttcccagccagatgttgcgcccatttcgactgcaactcgccgccgaatttgaggtggcaagacctgagcttggtaattcgttgattggcgcgcaaagttttccatcgacggcattgaaacgacactgacatcttcacctaacgtagctagtttcgcctgggcctgaagagctaaagcaacttctgacccgcttgcaatcaagattcccattggctggcggccacgctgcggtgagagaacataaccgccacgagccacaccagtcatggccttagtcttagatccggatagcactgccaaattctgacgggtcaagacgagcacggttggatgatccgtcgcgttgatggcttgccaccaagctgcgaccgtttcattcgggtcagcgggccggatcaccgttagattcggaatcaatcgtaaactcattagctgttcaattggctgatgagtcggaccgtcctcgccgactgcaatcgagtcatgcgtgaaaacgtaagtgactggtaacttcatcatcgccgccaatcgaatagccgcacgcgtgtaatcggaaaagacaaggaaggtgccaccaaagacccgcaagccaccgtgtaaagtcatcccattcaaaatggtgcccataccaaactcccggacaccaaaggcaacgttgcgctgatccggggtcaccggagtcgacaattgatcctgctcaatggtcgttttattcgaactggctaaatcagccgcgcccccgactaatcctggtaactgagcggctagcttctgaatgacggtatgactcgtgatccgcgaagcttgggcgccttcatcaaagatcggtaaactggtggctaagtcaactggcagacgcatactgagctgttgttcgaaacggtgttgtacggcttgtggtaaaacctctcgttgtgactgccaccggcgatgtgcacgctgaccacgttgcaagattagttgctgtgcgcgtttagcaacggccggcatcaccgtaaatggcgcggcttgccaccctaattgttgccgcaaactagttaaaccggccgttcccaacggattgccatgcaccgcattcgtacccgcttgtggtgcgccaaatccaatcgtcgttttaacagcgatcaggcttggacgtgaactgtgtttggcacgctcaatggcggcattaatcgccgttaaatcattgccatcacctaccgtttgtgtatcccaaccataactagcgaagcgctggttcacatcggtacgaaacgaccggctggtggggccatcaagcgaaacagcgttatcgtcgtacaatacaattaatttttgcaattgttgattaccggcaaagctggcggcttcgtgggagacgccttccatcaaatcaccatcaccgactaacgcataagtatagtgatccaccaactgcggtgactcggagaactgagccgctagttgccgttcagccagggccatgcccaccgccatccctaacccctgtcccagtggaccggtcgtggcttccacaccatccacgattcccagttcagggtggcctggcgtgtgactgccgaattgacgaaaacgttgtaactcgcccattgtcacgttgaagccactcacatgtagcagactgtacaacaacgccgacccgtgtccggctgataagacaaagcgatcgcgattagcccattgagactgctgtggatcgacccgtaattgtcggctccacagtacccacatcattggagccgcgccgagtggcaatcctggatgaccagaaccggcccgttcaatcatttccgcactcagtactcgtagattattcaccgctaattcatcaatttcatcaaatgcttgcattaacttcgctccctctcattttggctaataaaaaagactcacagttacaccaactgtgagtccactaattcttcgcagggtgcccgaaaaacaccgctactcagaagcagaaaagtcacacagtggttgttcacaacactgatatgacttttccataaattttaatcattccaaaatttactggtcacatccgttgcgagggcgtgcctcgcagtggatgccaaggcactaagtaaaccagtaataataatacgaattcaattgtaaattggtattaatcgtcatgattaaaatctccttaatttataatgtgtatttgatgacttaaaatatacggctaatcaatagaattgtcaaatggtttttgcaaactttttctattaatcaacaaaaacatgttggtccaccctcgatttgctagtcgtcatcatcctcgctaactgctaataaatactggtaaatcagcaagtttgcgtgtcaaatcattttacagatattaaaatggttccctgccactttctgaaaatatttttagccagtagcttgcactgacttaacttataatccaccgcaagacaaatcattaaagtctaaaagccgcactccaacgctaaatttctcacaacgaacgactgacaaacggtcattttcgattacaatttcaacaatgttccgtatgctttagcaactaaccttagccgctcgtcagttgtctgaactgccatctatgcccaaccagctagctggtcttcaccaccgcacataatcgtgataaccaaaaatagtatcgccagcatccagagcagattccagccacactatcatcagtttatgtgatccccattttagtcacaataattgccgcaactacaccaaactacgctttcaaggctgcggggactgccactccaaattcagcaccaacttgctgcatttccgtcaacgtctgtggatcaatactgacgccctgcaccaaattttcatcatagtgccggtattcccggtcacctggtatcatgatcttagtacctggtagatgcttcaaatgccgaatacggtcaaacatagtcgtcacgttggccttcaacacctcgggatcgccaaataaggcgggattaatcgtcatgaagaactgactaaagtcatgcttaccggtgttcgtatcagccgacagcgacccttgcgctaaaattcccgtgagtaactcaataattagtgagttgccaaagcctttgtaatttgaattgacttcctgctggccacctagggtcaggaccccaccaccaggacgattctcagaaaacgcaattttagtcaagttatcctccaccgtctgcgcatcatgcaagacttgacgatgctcatcaaccgcccaatcacccggaatctgtgcaccttttttggccagcacttgaatcttcccgcttgaaaccaccgcagtcgcgccgtcaaaaacgaaaggatgcgggtcggctggaaaagtaaaagctaatgcgttggaacccaaaaaagcttctgtcgcattcgtcggcaccaccaacggccgcgtattagtcgttgaaataccgatcaaacccgctttgcaagccatgcgcgaataatagcccgccgttccaaagtgattcgaattgcggataaccgctaatgaaacaccgagttgcttagtcttttcaatcagtttattcatcgtaaacgccgacgcaatctggcccatgctctggttcgcatcgatcaatagactggtaggtgtttcattcaaaatcttcggttgatgcgtcggttccaaggtatgatccttgatcatccgcgtataccaagccagccgctggataccatgtgacgagattccacgtaaatctgcatcgaccagggtgtctgccagcagtgccccatccttggcactaaaccgttgggccttaaaaactgcttctaaaaattgtcgttccgtttccgcactaattcgcatcgttatattttcctccgtttttgacagccagcactcgcctaacttggcgagcaccgggatatcacactttattcagattgttaaacagcttgaacacgttcattatccgattcctaattagaaaattcaatgttttatgtaaatataattaaaaacagatgtgtaaaacgttaatttttcaattatgccccactcagtttctttccttaactaacctttcactatccgctaagcggcctgtctttccatgctatattgaagacacttaaactagaggagggacccgcgatgcaccgttatacctatcatttttatacaggactaatcacgggcttgttaatttgggtccatcccctcggcggtctagctagtcgcgtacgaccgacactaccgtacccaccaaccacccttcaaagaacagccacccaagctgttttttcaccaaccgaattttatcaaaccatccgtcagtatccggatctggttaaactagcaaaattcgacccaatcggtatgttgcaaggcaccaccattcagccgggactacaagccaccctgactagggacctcgtcactaaacaactcacgacgacgacaatgatgattccacagggcgttgttattgccggtcgttatcgtctaaccaccgcttatgatgccactggtcgaacccaatctgtcctatatgtacaggatcgtttccgacatcaattatgcaacactgtcttattgcatggtaaaccacatgtgggtggtctagcttatgatcctcaccaccagcggatttggttgtgcagtcatcgccacggtcatggggctatcttgagcgttagtctggccgcattacggcacttcgacccgaccacttccattgccgttcactatcagcaacgctggtcactgccaacactgagcaatgcttcactactgacctatcaccatcaggccctttatgtcggccagttcaaacctggacagaccaccttggttgcccgctatccactgacgagcgccggcacgccatacagaatgaccacgagtcacgccattttaccaaaggcagttagtgactggcacggcaagctcccacccaatattcaaggaatggccttctatgaccactacgtcttgttatcacagtcatacggtcccagcgcctcacacttactgctattcaagcgcagccaattaattcaacagcaccaactgaccaccggtatcgcgattcttcgattgcctccgcaactcgaacagatcagcgttcatcatcaccaggcgcaactcctttatgaaaccggggccaccccctaccgccagcagcaaaatcacgccattgatcggctgatttcaatcaacttacagcgcctcattgaataggcaaattagtcgtcgaacctcatcaccatgactgaaaagcacggtcctagtcactacgccattattgcagttaacccataactgaccttccgatgcgtccagtatttactgacatgcccagttcaatttcttgatcagcattcacgctgctaccaggattgcgacaaccaactagttgttaccgtaaattactgctgtatgtaaaaatacagcatgtattaattttccatggccgcccaaataagcgtacaatgtaacagtaagtacaattaagggagaaagctatgtatcagctattaacagattcaaccgttgatttaccttatcaactacttaaggacaagcatgtcgattttgtttcaatgaacgtcacgattgacgaccaggaatacgcggacgatttgggtcaccactttgacttgactgacttttatcatcggattggtaacggtgtgatgccttctaccgctcagattaatatcggccagtttattgaatttttcaagccgtacgttcaggcacatacgccaatcctatacctcggcttttcatcaggcttaagtgggaccttcaataatgcgcaacaggccaagaccatgcttttacaagaccagccagatgccgagatctacctcgtggattcccgagcagcctgctgcggtgaaggcctgatgctactagatgccattgacaagcgcgatgctggtatgccgatcgcccaattggcggattggctgactgaaaaccgcctctattatcaccaatggttcaccgttgatgacttaaattacctttatcacggcggccgggtctcacggacctccgcgacggttggatcactcttacagatcaagccagtcatggacgtcgacccactcggccacttgcgtccagtacaaaaggtgcgctcacggcgccggtcactgaccacactagttaacaacacactagccgatttacgtgatcagaccaagccgcgcattatcattgccactagcgacgctcaggaagccgcccaaaccgttcgtgaaaagattttagccaaggttcctgatgctgaaattttgctcgaacacattgggccgactatcactagccataccggcctcggttgcgttgccgtcttctcttttggtaaaactaaacgtcagtaattaaaatggattgagccgtcaatggcccaatccatttttaagtaaccgagcgttacttgcttagtttgtttcaaggcgggctatattcgaaccaattagtatcaaataaaacctgcccaaatgggttatttatctcgttgagccacgtcatatggtttttttgtggtttttttctcactcaaccaaaaaaaaagcacccgtccatagacaggtgctttctcatatagccagaaaatgttgataaaacaacgtttttggataatattaacgttttgagaattgtgaagctttccgggctttcttcaaacctggcttcttacgttccttcatacgagcatcacgagttaagagacccgcgcgcttcaaaggagtacggaaatctgggtcaacttcgagcaatgcccgagcgatcccatgacgagttgcgccggcttgaccatggaagccaccaccattaacgttaactaaaacatcatattgatcagttgtttcagttacttcgaatggttgtaacaattccttgcgaatatctgcaaatggaatgtaatcttcaacagatttgtcattcataacaattttaccagtacctggtactaagcgtacgcgggctactgaatctttacgacggcctgtgccgcgatattgtacttgagccaatgtagtttcctccttagattaagttagtgatgtccaaaacttcaggcttttgtgcttgttgcgtatgttctgcaccagcataaacatgcaacttcaagcccatcttgtggcctaaagagttgtgaggaagcatacccttaactgaagtttcaatcaatttagtaggttcctttgccaagaagtcaccggcagtccgttcctttaaaccaccagcataagcagtatgatgataataaatcttccgttctgctttcttcccagttaaagcgaccttgcttgcattaataacgataacgttatcaccagtatccacgttaggggtaaaggtaggtttgttcttaccacgcaagattgatgcgacgacagttgaaagacgacccaaaggtacatcggttgcatcaactacataccatttacgatcaatttcacctggtttagccatatatgttgtacgcacgttgtgttcctccattttctgtgtttgtttgacactcaataagatttccggggcttatcgtggggcaaacaataccaacgactagtctacctaatttcgcctcagaagtcaatactttatcaaatcagcttgtaattcattttgttcataatacacttttttcatataaagtccagccgcgggagccgttccccgcgcttgctcacggtccttagccgctagtaacgctggaatacagtcaactgcgcgccggccctgaccaatttccatcaaaacagccaccatgattcgaacctggttatataaaaaaccactaccgcaaaattcaaactgaatttcgcgttcatccggcaaggcccacgctttggctgaatagatctcacgaacatggtcatgtgcttgtgaaccggacgcaacgaaggtcgagaaatcgtgccgtccttctaagtcaccgatggcttgctgaattcggtcgatatccgcagcgaacttaaaatgccccgtatagtgccgtttaaatggatctacaaattcattttgataggcccgataccagtaccgcttaccgaccgtatcataacgcgcgtgaaaatcattcggcacaatggaaacggcctttacgattgtatccatcggtaacatgctgttcaggccgcgccgaaccccttctggattaatttcgtacggcaagtcaaaatgcaacgtctgtccaaacgcatgcacaccagcatccgttcggcccgcgccgtagatcacaatcggttcaacgggatctttcgccatcttattgaccgccttagtgacgacctgctcgacagttcgctggtgtggctggcgttgaaagcccgcaaaattggtgccgtcatatgctaaaactactttataccgcgtggtcacaatatccctccagttaaaaacgtgggtcgccatcagtgcgacgcccacgttaatcagtcttcatttatgcacgcaagaaaatcaatgcaacggtcaagatcgcaaagcatccggtagcccacgtatcacgttggtgccacttaagaatccggtacttactgcgaccctcgccgccttgatagccacgtgcttccattgccgttgctaaatcctcagcccggttgaatgagctgacaaacagcggaatcagcagcggaactacggcacgcatttgttgaaagatattgccctcaccaaagtcgaccccccgggcccgttgtgcattcataattttttccgtttcgtccatcaacgttggcacaaagcgtaaggcaatcgacaacatcagtgccacttcatagactggaaaacggaccgctttgagcggcatcaagatatactcgatggcatccgacaattccagtggcggcgttgttagagttaacagcgttgacataaaaataatcaacacgaaccggcaaaaaatatagaccccgttgatcaatccaagttggctgattgtaatgatgccccattgaaagtaaacgtgcccgccacttgcactaaacaacacttgcaggatgacggtgaataaaatcaaccaaatcagcggtttgacaccgttgatgaagaacgaccatttcacaccggataggtaaatagcggccaatgtaaagacaaatagcaaggcataggtcgcccagttattggcaataaaaataatcccaatgaaataaaaactcaataacagtttcgcccgggggtccatatggtgaaccacggagtctcccggaatgtagcgaccaaagatcaatttattcatcatgagcggccacctcccccatcgcgttcggtggcaactgttggacgatggctgctgctaattcgtcctcggtcaacggccactcatcaaattgccagccttgcttttggagtgtatgcgcaaaggccgttgttttcggtaagcccagttgatgggcagttagccacgcaggatctttgaagatctcacgaggcgtccccgttttgacgatttgtccacgatccatcacgattacattatccgcgtaattagcaacatcatccatctgatgggtcactagtaccacggtcaaatcacgttcatgacgcaaacgggcaaacatctccatcatatctaaacggccctgagggtccaatccggcagtcggttcatccaagactaggacttgtggctgcatcgcaaggacccccgcaatggccactcgccgcatctgtccaccagagaggtcaaacggtgaccgcgtcagtaacgactcgtctaacccaactaaagccaacatttcagccgcagttttcaaagcatccgcttcgctagccccaaagttctggggcccgaacgcaatgtctttggccaccgtttcttcaaacaactgactttctggaaactgaaagacgatgcccacgtgttgccgcaatcgcttcaagtccttattactcgtcgttggcgtaatgacccgttcaccaatcgtgaccgttccactagtcggtttgagtaaggcgttcaaatgctgtaaaagtgtagacttaccactccccgtatgaccaatcaaagccgtataagagccggtgggaatggtgacgttaatatcagttaacgccttagtttcgaacggcgtacccggttggtaagtaaaatctacttgtttgaacgtaattgccataaccagtccgccattcctttctctgttaaatactgtgcgggcacttgaacaccctgccgctttagcgctgcttttaagcgctcagcatatggcatgtccaatcccatcttaattaaggcttctccatgctgaaaaatttccgctggagtcccctcttccttaacctcaccgtcattgatcactaagacccgattagcgctggccgcttcgtcaatatcatgcgtaattgacaagaccgttaacgctgaattagccttcatatcgcgaatcgtcgtcaatacttcctgacgaccacggggatccaacattgacgtcgcttcgtccagaatcaaaatctgaggccgcgccgctatcataccagccagcgccacccgttgtttttgaccacctgacaaacgtgccggttcacgtgtcgcaaaatcctgcatgttgacttgttctagagccgcctgtacccgcgctagcatctcaggacgcggcacgccctggttttcaaggctaaacgcaacatcatcggcaacggttgccccaacgaattggttatctgggttttggaaaaccatcccaattttgcgccgaatgtcccaaacggtttcttcagataatacttgaccatcaaccgtaatcgttccggccgctggtgctaacagtccgtttaaattcttggccaaggtcgacttaccagaaccgttatggccgacaatggcgacccattcacccggcatgaccgtaaatgaaatatcgtgtaacgttaactgatccgtagcttgttgcgggtaacgataatctaaatgtttaacgtcaataatcggactcaccattgtccctcatttccttaaaattcatggttattatcataacatatctgacggaacttgtagtaactgaacttcacgtccaatcttactttaaatcagtggctggcccgtatttgtaaccagcatcgccaaacagcgtgaactgcttcttcaagttattggagacgtatacttttttatccttggtaataaaaatggccccaataccttgatccgctttaccattaatgtacttcatcccgcctttgaggcctttgtcaaaggtggccgtcgatagtgcatcgccatccaccgacttcttcgagatgatggaaacgcccatcaaattgttttgataaggtgcccctgtttgtgggtccatcaaatgactgtaaactttaccattcttcttcaaatagcgttcatagatcccagaagtaacgattgacttattcttagcaggtagtgagccaatggccgtaccccgtgacgcttttggatcttggataccgactgtccagttacctgacttcgttcctttagggctgtcacccagaacataaatattaccaccgaggtcaataatggccgttgaaaccccatgatttaataagtacgtcttcacttgatcggtcatgtaacccttggcaatcccaccaaggtctagttgcattcccttttcttctagataaacggtccgtttcttgtcatttaatttaacttttttgtagtctaccagcttaacgttcttatcaatttcttgttgagtgggcaccttggcatcggaaaatccaatatgccagagtgatgtgatcggaccaatggctaaatcaaaggattcgtctgaattcttactataatagtaagctgctttgatcattgggtagatatccttgctgacagccactggctttttaccggcagcggcgttgatcttatcaatttcagatcctttttgattgaccgtaatttccttagcttccgttttcaacagcttaaacgccccagctaacacgttatccttacccttattataaatccgcaacgtgacaactgtgcccatcatgaactgggtatcctcgatcggcgtcttgacgaccttagttggtttgggtcggctactagcagcatttttgcgactcgtactcgtcccacacgccgtcaatggcacgatcattgcaacaattaatccaattcgaacccatttttttagcttcattccaatacttcccctatttttaatttcaattgtcattataccaaagtcttgattcatccggtgagactgtttgcgcgtcatccaagcttttctacgctagtctgacatcagcgcacctacagcaaacggtacaactcgacggtcgggtttgtactaccacagccattttgcacttaacattcaccgccactattattttttaaaccaatatccatgtatggatttagcttgctcaaagtcgtgcccaactgagtgacaaacttttgtggttgttcaattaaaaacaaaaggccctcagcatgcgcctcaggcctcaaaagaatctaataattaaattgcttattcagagaaaatcatgttgtcaacagtaatcgtgttggtgtcacccttttgtgccgcgttttgtaattgttccgcgtacataataaaggtgttagaagattcagtggcacccgtgacaacgtcaaccttagttggatcactactcttaactaatgacttgttcaaagctggttgataagtcttagggttagtcttagcaaccttcttcatttgcttgttgtaagctgcatcgtcaactttggacttgccattcttgttcacttggttatattcagacttcgtaatcttattatccttgaccgtgattgcgaaagtaactttgtaaccgtgtgagtagttcttttcgttcaacttgtaggtaccatctttcatcttggcaccattgtcaatcttaatggtcgacttgttacccgcttgggcagcttgaactaattgttgtgtgtagttttggaaggtctttgatgattcagtcgcaccagtcacaacatcaatggagcccacgttaccagtagcggcagagcccgtcagcgtcttgtttaacttaggcatgtaagtcttggggttagtcccagcgatcttcttcatttgtttgttatatgaagtatcatcaactttggacttgccgttcttgttcacttggtcataactggacttagtgattttaccgttgttattaactgtgatactcatcttggtccgataaccatgtgaataattttcttcttcaaggttataagtacccgctttcattttgctgccagcggttaatttagcaaccttagttgtcttagctgatgagcttgaagatgaactcttcttggatgaactcgagctagaacttgaagaactgttgccacaacctgctaaagctaaagctgaaattgcaacaactgaagcacccgtaataactgatttgaatttcatgatatcccactcctaacctttttgtatgaaaattcacattaatcttaacgtttaaactggtaatagtcaatcccattccattaaaaaaatgatattttagcctaataatagcggtattgacaacgttttccgttcaaacctcgatgccactattttcgcggcttagataatgtgatagtttatgcattctttcccataatccatagacaaccgcttacattatcgttataattattagtggaattatctttttacactattattcaagggagttgttacgcaatggcaaaggaaaatattgtcgttgtcggtgcggggtttgctggtgtttacgcaaccaagaaactgtctaagcatttcaaaaaaaatgcagacgtcgagattacgttgattgaccggcattcatacttcacgtatatgactgaattacatgaagttgctaccgaacgggtggaacctgagcatatccaatatgatttgcaacggttgttcgcacggcgaaaaaacgttcgtctcgtgaccgataccgtgacgggcatcgacaaaaaggcacaaacagttactaccgaacacggaagttatcaatatgatcaacttttaattagtttgggtggggaatccaatgactttgggactcccggtgttaaggaacacggcttcgaattgtggtccttcgaacaagcgatggcattgcgtgctcacttatctgcaattattcggcggggggcggcggagctcgaccctgctaagcgcaaagccatgttgacctttacagtctgtggttctggttttactggttctgaactgattggtgaattaatcgaatatcgtgatgttttggctcgagacaacaagctcgatccaagtgaaatcacgctccaattggtcgaagcagcgccgactattattaacatgctcaaccggacgcaagccggtaaggccgctaagtacatggaaaaacatggtgtcaaaatcatgacgaactccatgattaccgaagtctgtgaagaccatgttaacttaaaaggcaaggatccaattccaacctacacgttaatctggacagccggtgttcgtgctaatagtatcgttaaaaagttcggcattgaaactaacccccgcggtggtcgcttgatggccaatgaattcatgcaagctaaggattgtaacaatatcttcttagccggtgattcaaccagctaccaagaacctgaccaaccacggccagtcccacaaatcgttcaaggggctgaagaaaccgcagctaaggccgtcgaaggtattattaagaacgttgaccagactgacgttacgatcaagccatttaagggcgcttatcaagcatccgtcgactcaattggttccaaatatgccgttgcacaagttttagagaagtggaacgtctctggttttattgccgtgcttttaaaacacgccatcaactggatgtactacgttcagattttctcaggttactacctattccagtacttcatgcacgaattcttccggactcgtaataaccgtaacgtcttccgcggttgggtctcacgggctggtaacgtactctggagtgtgccactgcggttcttctatggtgccatgtggttatgggactgctggactaaagttcagggatctgaatcctggttcactgacaagttacggttaccattcgaatggattaccgtggccgcaaccagtggtgcctctcaagcaactaaagccgctgcaaccagtggtgcttctgaagctgccacgtcaaccgctaaagccgctaagggtgtcttcagtctttcatacatgtacggtaaagaacccctgatggtctttgacaaaatgccacattggttcgaatcaattaccaaggtcttcattccgaacatgcaaatggccctcttcttccagaaattcatgacttgtgttgaaatcgtcattgcattatgtattttcttcggactctttacttggtttgctaacgcagtcaccattggcttagttgtcgtcttctgcttatctggcatgttctactgggtcaacatttggatgatctttgttgccctcgccttaatgaacggttccggacggacatttgggttagactactgggtcgttccgtggatgcaaaaacaccttggacactggtggtacggcaacgttcgttctcattacgacggtgttaaaacccgctagatgcgttataattaattaaatcctttcccgatggttcaagggttgtttttccccccttgaaccattttttatttcattgaattggagggttaacgatgcgtaaattacggacaatgatccggacattcaaacgttatggggatatgatcaagccgtttgatattattattattgttgcgctaattattttatcgttcaccccactagcgattttttcataccagcaaaaacaacaagctgaacatgcggcactagtggctaagcgaaaggccacgagcagtgaaaccacgtataacgccgtggtctcacataatgggaccgtcttgaagcgtgtcaatattacgaatctgaaaacgactaagcacttcacctatcgcgataaccatgggcactacaacacgatcacatttaaacctaagcgcgttgcgattacgaaagccaactgttctgaccaagtatgtgtccgccgaggctggattcataaacctggtcaaacgattgtttgtttgccccacaaactcttggttgaaattaaggccagcaacggtcaagtcaaatctggcggtaatggtttagttacggagtagaatatgaataattcatttgaacgatcaaacaaaactcatcgtaatatttatatcgcgttactggttgcacaaggcgtgatcatcggcatccttgaacggatgattccattcccgtttgcctttgccccaggtgccaagcttggtttagccaatctgattaccattgttgcaatctatacattatcattaactgacgtgataaccctaacctggctccgtttgattttaacggccctcctaggtggcactttatcaacctttctgtatagttttgggggcgcctttctcagcctgtttgccatgctgttggtcaaacaattagggcctaaacgcgttagtattattggaatttcagcaactggtggcgtcatgcataatgttggtcagctattggtcgcgagtcttattgcacagacgtggacggtcatgctctacttgccagtgctttcgattattggactagcagcgggaagtgctctcggaatcgccgccaactacttgttcacccacgtcacgatcttacgctatctcaaattcaatcgagaacaccatccagatcaaacaaaggagtaacccatatgcaatcggcaacacaattacacccaatttggcgtgattacccggcactacaaccggagctgcaacaagtgatgcagctgatgacggcgaacatcaatattcaagatgccgacatcaatgacgcgattttagaaatgattcatggtggtggtaagctcttacgcccggcatactgcctcctattctcacaatttacaacaactgatcggcaacggatggtggccttagcggcgtcattagaaacgctccataccgctacgctgatccatgatgacattgttgacgatgctgcactacgtcggcaccatgtcacgattcaagaacgttttggtaaagatactgctgtgtatgcgggcgactacctattcgttgtggtattcaagattctagcgcactattcaagcagtttcaaaagcatccagatgaactctgagaacatggaaaagattctagtgggcgaggtccaacaaaaggaccgccactaccaccttgacattaccatggcagaatacttgcaacaaattcaaggtaagaccgccgagttattcgcactgagttgttttctaggtgcttatgaatctggtcaaagtagtcatttcgcccagcgcgctcgtaaagcaggtctcgcaattgggatggccttccaaattcttgacgatattttagactatcaagaagtcagtcaggaaacgggcaaacccatcctcgaagacgttgctgaaggtgtctacacctcgccgttgatttttgccttacagacagaagctaagcacgatttattgccgctgatgcgactacagggggcaatttcggacactcagcgccaggaagtacaacgacttgtcatcaatgccggcggtgtggtgcaagcccaagaactcgctaccaagtacactcaagacgcgctggcaatcatgcgtaaacttccagaccagcctgcgaagacggatctgattagtctaaccaaacggctgttggaccggcataattaactagtaatcaatcgactaaggtatcaagcatcctgtttgataccttttttgtcgcccagacacagctaaacgcccatgtgcttcatcttcacagtcagtacctgagaccactatattcactttcccgattcaacaggtcataatctgcaaataacaaaccgttgtcatcacgagtattaaaaacacctatccattccaacaaaaaaccgctgatttagggaatcaatccctaaatcagcggttgctcgtaactagcaccaaaaaaaatcacttagaactgcgatatgccatctatgtctaaccataaataacttccgaactagacttagctactattttgccagtagccaccatcataacgcccgtcaatcatcagtcccagtgatccgtaaaacaatcttaactagtcaacgagttccaagacaaccatttgtgcaccgtcgccacgacgaggcatagtcttgtaaattcgtgtgtaaccaccattgcggtcagcatattgaggacctaagtcactaaatagcttttgcaatgcagtttgtacagccacgttgtcgccatcttccttaacatcggcaacgacgtcccgcatgaatgcggcagccttccgacgggcgcttaaatcgcccttcttggccaaagagatcattttgtcagcagttgaacgaacttccttagcacgggcttcggtcgtttcgatcttgccgttaacgatcaatgacgttgtcaaatcgcgtaataaggcacgacgttgtgaacttgtacgttgtaatttacggtaactcatgaacggatatcctcccttgtattagtcttctttgcgtaatgataacccaaggtcagctaattttgccttaacttcctcgagtgacttgcgtccaaggttgcgaaccttcatcatatcagcttcagttttgttagttaattcttggaccgtgttgatgccagcacgcttcaagcaattgtatgaacggacggagagatctaactcttcaatcgtcatttctaacatcttttccttatgcgtttcttccttctcgaccatcacgtcagtgtttttagcttcatcggtgagatttacgaagattgaaaggtgatcagtcaggattttggctgatagactaatggcttcacttggagtgattgaaccatttgtccaaacgtctaaggttaacttatcgaaatcatcacgttgaccaacccgcgtgttttcaacttgatagttgacacgttcgattggagaatacaatgaatcaacagctaaaacgccaattggcatgtcatcttcacgatgtttgttatcctcagcggaaacataaccacgaccagtatttgcggtcatacgcatatggaagtgtgccccgtctgctacggtacaaattggtaagtctggattcaagacttctacgtccgcatcgccaatgatatcaccggcagtaacgttagcaggacccttaacgtcgatttccaacgtcttggtttcgtctgattccaacttaagtgcaatcttcttaacattcaagataattgctgtaacgtcttccgttacgccctcaatcgttgaaaattcatgaagaacaccatcaatttgaatactagtaacagcagcgccaggtaaagaagaaagaagaatccgacgaagtgaattccctaaagttgtaccataaccgcgttcaagcggttctacaacaaacttaccatagttgtcgttttcatcaattttatgaatgttaggtttttcaaattcaatcattcttatcttttacccctttcaaaacgcgtggtgtttagtagttgtgcgtacaaaatgaagtttgccctcaaaatgaacgtcacagattaaacacgacgacgctttggaggacgagaaccattgtgaggcactggcgtaacatcgcgaattgcgctaacttccaaaccagtagcttgtaaagcacggatagcggcttcacggcctgaaccaggacccttaacagcgacttcaacagtcttcataccatgttccattgatgccttagcagcagcttctgcagccatttgagcagcaaaaggtgttgacttacgactacctttgaaacctaatgaaccagctgatgaccatgcaatggcgttcccttgcatatcagtgatcataacaagtgtgttgttgaacgttgaatggatgtgagccacaccagattcaatgttcttctttacccgacgacgacgggttgtctttctagttgccataaaattcgaaaacctcctttattattattttttacgtccagcgatgctgacctttttacccttacgagtacgagcattgttcttcgtgtgttgaccacgaactggtaaaccacgacgatgacgcatgccacggtatgaaccgatttcttgcaataacttgatgtttaagctgacttcacgacgtaagtcaccttcagttttgtaaccatcgacaacggcacggattttgtcttcctggtcaggagttaaatcacgtacacgaacgtcttctgaaacaccggcttcagcaaggatcttctgtgcagaagtgttaccgataccgtagatataagtcaaaccaatgacaatacgcttgtcacgtggtaagtcaatcccttcaatacgagccattaatatttcacctccaacttaattaaattatttaccttggcgttgcttatgctttggattagcagagcagataatcatcacgcggcctttacgacgaataactttgcagtgttcgcacattggctttacagatggtcttactttcatgagttttttacctcctataaggtacgtagaccgagcctacttgaaacggtaggtaatccggcccttagttaaatcataaggtgacatttcaactgtaaccttgtcaccaggcagaattcgaatgtaatgcatccgaatcttacctgatacgtgtgccaagatttcagcgccgttttcaagttcaaccttaaacattgcgttcggcaacgtttctttaatggttccttgaatttcgatgacgtcttcctttgccaagtactgtccctccttattatcagattccgtgctaccacgtatttggtccattactgaaccagtcattgtctaatcataacattaaaaaaatattaaatcagtcaacggctaaacctgaataattttatcacaacgacctttgaaaagcaaacgtcgctgctgaaggaacctggtttacaggttatcaagaattttcttgatatctttgtagacatcatcaatgtcgcgatcaccgtcgacattgtagagtaacttttcttgaccgtaataatcaattaatggcgtgttcaacttaatgttcacgtctaaccgattcttaacggttgctggcttgtcatcatcacgttgatagaaatcatgaccgccacacacatcacaggttccttctaccttaggcttgttgtacaacttatggtaagttgcaccgcaagtccggcagataaaccgaccggaaagtcgttcaacaagtactgcgggttcaacatgaatgttgatgaccccatcaagtggcttattgagttcttcaccgatttgtttcaaagcatgagcttgatcgatgttacgtgggtaaccatctaataggaaaccatttttagtatccgcttcagctaaccgatcacggacgatgccgttagtgacttcgtctggtactaagttacctgcatcaatatacttcttggcttccaagcccatcttcgtttcgttcttaatggctgcacggaagatatctccggtcgagatatgtggaatatcaaaatcttcaagaatcttctgtgcttgagtacccttaccggcacccggtaatcccattaaaatcaggttcattgttgacatgttttttcctcctgaatgcacaaatgtgttgagtctccccaacacattcgctgattaacgaatgaaaccgacatagtcacgtttcatcatcaatcctttaatttgacgaattgtttcaagggcaaccccaacaacgattagtaaactcgtcccacctaaaccgattgattcatcgagaccccaaatatcagaagctaataatggaatcaaggaaatcaaccccaggtagagggcaccgaccgtacttagtcgcattaacaattttgaaacccaatcttgagtatccttacctggccaaacaccaggaatatagctgccttgcttttgtaagttcttagagagcttttcaggattgacctgaacaaacgcatagaagaacgtgaagagcacgatcagaatggtgtaaagaatagcaccagtcgtcgactgcatattgaagatattactcaaaacggtataccaggtttcgtcaccatgactggattggaaccctagcaaaatcgtttggggcgttgcaatgaaggaactcgcgaaaataacaggaataaccccggcaacgttcacctttaatggtaggtaactactgtcaggtgcaccagctgcacgacgagtgtattgaattggaattcggtcattagcttgttcgacccacgttacaaacataacgatgatcagcacaagcaaggctaacccaacaacaaacaagccactcttccaccagtcgctctgtgaaacattaacgaactgttcttgataaatttgataaatcgatgttggcatacgggcaatgatcccggcgaagataataatggaaaccccattaccgattcctcgatccgtaatcatatcacccatccaagtcgtcagcattgccccaccagtgaggatcaccccaatggtcaggtaagtcgaaatacttggattgttaacgagcttgagttgactcaaagagttaaaaccagccgtaatcccaatcgactgaacaaaggccaagacgatcgttaaccaacgggtcgcttgattaagcttgcgtcgaccaacttcaccttgtttgccccattcaacaaacttaggaacaatgtccatttgtaacaattgaacgatgatttgtgcagtaatgtaaggggatacccccatagcaaggatggaataatttgttaaaccgccaccactgaatgtattcaacatacttatcagccctgaagatgccaccgactgaagtgcctgtgcattaactccaggaactgtgatataagagccaagacgaaatacaatcaaaacgcccaacgtgaacagaagtttattccgaatatccttaactttgagagcgttcttcatggtagtcagcaaattagatcacctcagttttaccgccagcagcttcaatggctgcaaccgccgttgcagagaacttgcttgccttaactgttaactttttgttgagtttaccattaccaagaactttaacagcagaactcttcttaactaagccagcttcctttaatgattctggtgtaacttcggcaccatcatcaaaacggtttaagccgtcaaggttaacaaccgcatattctttacggttaatgttagtaaatccacgcttaggaatccgacggtacaatggcatttggccaccttcgaaaccgacacgaactttaccacgcgccttttgacctttttggccacgaccagaagtcttaccttggccacttgagtcaccacgaccaattcgacgacgtgaaaaacgtgaaccttcactaggtgttaattcatgtaacttcatttagtaggcacctcctctttgaaaatttgaattacttgatgatttcgacatcgactaagtgtgcgatgtggaaaatttgaccgcgagttgctgcgtcatcaggtttaacaacggaactattaatccgacccaaacctaattccttaacgattttacgttgcttaggaagacggtgagcagcactgcgtactaaagtgatctttaattgagccatgttgtttgtcctccctattcagctaaatgttcggctgaaacgccacgtaaagcagcgacttgttcagcagtctttaagctctttaagccttcgaacgttgcacgaacaacgttaacgggggtgtttgagcctaatcgtttactagtaacatcatccacaccggctaattccatgacggcacgaacggcgccaccagcggcaacaccagaaccttcaacggctggcttaagcatgatgcggccaccaccgtaaacaccaagtgcttcatgaggaatggtggtaccaaccattggtacagtgatcaagttctttttagcagcttcggaagctttccgaattgcttctggaacttcttgagccttaccagtaccgaaaccaacgtgtcccttgtggtccccaacgattactaatgcagcaaaacgtaggcgacgaccacctttaacaactttggtaatccggttaatggcaacaacattatcgtcaagatctaattttgatggatcaatgaaagtcatatggtattattcctcctttgttagaatttaagtccgttttcacgagcggcttcagccaaagcttgaacccgaccatgatataagtaaccgccacgatcgaaaacgacgtcaacgattttcttttcagcagcgcgcttagcaacaacttcaccgacagatgcagccttttcagtcttgttgttacctttaacttcgctatctaaagttgaggcacttgcgagcgttacaccctctacatcatcaataacttgagcgtagatgtttttgtttgaacgataaacatttaagcgtgggcgctcagcagtcccagaaatcttaccgcgaacacgtgcgtgacgacgttgacgtgttttgtttttatctggtttggaaatcacaatagtcacctctatatattagtatggacagctttacgctgcattatttaccagtcttaccttccttacgacgaacatattcatcgacgtaacgaatccctttacctttgtaaggttcaggtgaacgaacggcccgaacttcggcagcaaagtcaccaacagcttgcttaccaataccagaaatattgatatgcgtgttatcaggaacttcaacagtcaagttttcaggcgttgcgaattcaacagggtgtgagtaaccaacgcttaatactaacttcttgccttgcaattgggcacggtaaccaacaccgaccaattgaaggttcttagtaaagcctttagtaaccccttcaaccatgttgttaacatttgcacgggtagtaccgtgtaatgccttcatcttgtagtcatcagatggacgagtgaatttaacttcgttgccttcaaccgtcatcgtaatatcactggcgatgttccgcgttaaagtacccttaggacccttaaccgtaacgacttcaccagcttgtgatacttctaccccagcaggtagttcaattactttataaccaatacgactcacttacttgcacctcccgtcttaattaatgattaccaaacgtaagctaatacttcgccgccaagcttcttggcgcgagcttctttatcagtaatgacaccttctgaagttgagatgatagcaatccctaaaccgtttaaaaccttaggaacagcatcagccttgacgtatgaacgtaaacctggctttgaaatacgcttcaagccactgattacacgttcgttgtccttaccatacttcaagaagacgcggatgatgccctgtttgtcatcatcgatgtattcaacgtcgcgaacaaaaccttcattctttaaaatttcagcaatgttgcgtttgatttttgatgcaggaacttctagtgaatcgtggcgtaccatattagcgttacggatacgagtcaagaaatctgcgattggatcagtcatcatgaaagtttaacctcctttaacttgggtttgtttttaccagctggcctttttcataccagggatttgacctttgtgggccaggtcgcgtaagcagatacggcacaagtggaatttacggtaaactgaatgtggacgaccacaacgttcacaacgggtgtagttttgtacgttaaacttagcaccgcgcttttgtttagcaatttgtgattttttagccaacttcgattaacccccttcggttatttagcaaatggcatgccaaattgagttaacaactcacgtgattcttcatcactatcagctgtcgtaacgattacaatgtctaaaccgcgaacacggttaacattatcatagttgatttctgggaagatcaattgttcacggacacccaatgtgtagttaccgcgaccatcaaatgaacgagtacttacaccatggaagtcacgaacacgtggtaatgaaacattgatcaacttgtccaagaagtcatacatacgttcgccacgtaagtcaaccttggcaccaattgccataccttcacgaagacggaaaccagcgatagatttctttgcccgggtaaccaatggtttttgaccggagatcaaagttaattcttcaactgcttcgtctaagtttttagcgttggtaactgcatcaccaacacccatgttcaaaacgatcttagccagcttaggcacttgcattactgaagtgtaattgaacttgtcaactaatgctggaacgatttctttttcatattgagcttttaaacggttttccatgaaacttgcttcctcctttcagtcagtcttagttttctaagtctttaccagactttttagcgtaacggacacgcttgccatcttcacgacgaacacctaaacgtgtaggttcgttggttgatgggtcaaggtacataacgttagaagcatcgattggtgcttcgatgtccacgataccgccttgtgggttaacgttcgttggtttttggtgtttcttgatcttgttaacaccttcaacaacgatccggttcttggcagagataacctttttaacagtaccttcttgaccacgatccttaccgctgattactcgaactttatcaccagttttaatcaacattaggttgcgcacctccttatttacggtgtgtgactagagtacttctggcgctaatgaaacaatacgcatgaagtccttatcacgtaattcacgagcgacaggtccaaagatacgagtaccttgtggagtcttgtcatcacgaataataactgcagcattttcatcaaacttgatgtatgaaccgtcagcacggtgaacaccagacttagtccggacgatcacagctttaacgacatcatgagctttgacaacaccaccgggtgttgcttgtttaaccgtagcaacaatgacatcaccaatgttagcagttttacgaccagaaccacctaataccttaatagtaaggatttcacgggcaccggagttgtcagcaacttttaaacgactttcttgttggatcacagtaagtgtcctcccttcatgtaattttattcagctaataatctagataataacagctttttgaacaacttcaattaagcggaaacgcttagtagctgatagaggacgagtttccatgatcttgacgatatcgccagttttagcttcattcttttcatcatgagccttgaatttctttgaataacgaacacgtttgccgtataccggatggttcttgtaagtttcgacaataacaacaatggttttgtccatcttgtcagaaacaacgcgtccttggataaccttacggctattacgagtatcttcactcattcgtgattgcctcctttatactctacttgtttaactcttgttcacgcaacgcagttttaatacgcgcaatgttcttacgaacttgttttaaacgagcggtgttttcaagctgaccagtggccaattgaaaacgcaagttgaaaagttcgtctttgtaagacttttctttttcgagcatttcagtagtggacaatgctttaatttccttagccttcatctgattcgccacctacttcctcacgcttaacaatcttagttttaacaggtaatttagttccagccaagcgtaaagcttcgcgtgcaacttcttctggaacaccagcaacttcaaacataatcttgttacgtttaactggtgctacccaacctgcaggagtacctttcccattacccatccggacaccgacacctttttcagtgtaggacttgtgagggaaaatcttaatccataccttaccgccacgcttcatgtaacggttcatagcaacacgggcagcttcaatctgccggttgctgatccagtgtgattcgagggtttgtaaaccgtaatcaccaaaagcaactgttttaccgcctttagcttcaccgcgcattttaccacgatgaacacgacgatacttaacccgtttaggtaccagcatgtttagtttcctcctttagcagatttcttttctggcaagatttcgccacggtagatccaggtcttaacacctaatttaccgtaagtcgtccgtgcttcgacccatgaatagtcgatgtcagcacgaagcgtatgcaatggaaccgtaccatctgagtatgcttcaacacgagacatgtcggcaccgtttaaacggccagcaacttgtgtcttaatacccttagcaccggaacgcattgtacgttgcatagcaccacgcatcgcacgacggaaagcaacccggccttccaattgacgcgcaatactttcaccaactaatttagcatctaaatcaggcttcttgatttcgatgatgttgatgtgtactcgcttaccagttaaattgtttaattctttacgaagagcttcaacttcagaaccacccttaccaataaccatccctggttttgcggtatggattgaaatgtttacgcggtttgcagcgcgttcgatttcaacggtggagacggaagcgtcggcaagtcgttgttcgatatacttacggatgcgtaaatcttcgttcaagtaggcagcaaaatctttttcagcgtaccattttgcttcccagtcgcgaatgattcctacacgtaatccggttggatttactttttgacccacgcgttatccctcctatttttcagtaactgtgatcgtaatgtggctagtccgcttgttgattggtgaagcagaaccctttgcccgtggacggaaccgttttaaggttggtccttcgttaacaaaagcttcgcttacgaccaaatcttcgcgatctaagtcaaagttattttcagcgttagcaacagcagaaagtaaaactttttctactactggagaagcaccccgtggagtgaacttcaagattgctaaggcttcggcaacacttttacctctgataagatcgacaactaggcggaccttacgagcggcaatacgaacagtttttgcagttgcacgtgcagatgttacttgttcagccattctttatatcctcctaactattacttcgttttcttatcgtcagttccatgaccatggaacgtccgtgttggtacaaattcacctaacttatgaccgaccatgtcgtcttggatgtaaactgggacatgcttgcgaccatcataaacagcgattgtgtacccgataaaacttgggaaaattgttgaacgacgtgaccacgtcttgatgacagatttcttgtcagaatcagattgtgcatcgattttctttaataaatgcgcatctgcgaaaggtcccttctttaaactacgacccatcgtgtgacctcctctcgataactacagtaaattcaaattttattagtgtttgcctggacggcgaccacgaacgataagcttgtttgaacgagccttcttgttccgagtcttcttaccaagcgtcttcttaccccatggagacattggagatggatgaccgattggtgctttaccttcaccaccaccatgagggtgatcgttagggttcattacagaaccacgaacagttgggcgcttaccttgccaacgtgtacgaccggctttacctgagttgattaattcgtgttgttcattaccaacagtaccaatagtagcacggctagttaataatactaaacgaacttcaccagaagacaaacgaacaattgcgtacttgccttccttacccagtaattgtgctgaagtaccagcagagcgagctaattggccacccttacctggcttcaattcaatgttgtgaataacagtaccaacagggatgttagttaatggtaatgcgttaccaaccttgatgtcggcttcggcacctgattgaacttgcataccaacttccaaaccttttggtgctaagatatatgatttcacaccgtcagcgtaaactaataatgcaatgttagctgtccggttaggatcatattcgattgccttaacggttgctggaacttcatccttaatccgcttaaagtcaaccaaacggtattgttgcttatgaccgccgccacgatgacgaacagtaatgtgaccataactgttacgaccggcagtgtgactttgtgagtctaataatgacttttcaggcttcgtcttagtgatttcagagaaatctgaagcagtcatattacgacggccgttagtggttggtttatacttcttaatacccactagagttacctcctaaattagatttattgttgatcgtcgttgaacaacttgatttcgttagaatcagaacttaaggtaacaatagccttacgacgcttcttagtgtagccggcgtaacgaccttggcgcttaagttttcctttaacgttcataacgttcactttaacgactttaacatcgaagatttcttcgattgcttttttaacttgggttttcgttgcctgtacgttgacatcaaatgtgtagcgcttgtcgtccaagtcagccattgatgattcagtaactacaggacgtaaaattacatcgcgtgcttccattatgcgagcgcctcctctaattgatcgagggctttttgggtaacgactaatttgtcactattagcgacatctaagacgttaacacctttggctttaaggatcttaacatttggtaagttacgacctgccaaagcagccttttcattgtcctcttcaaccaaaacaagagtcttggtatcgacgttgaggttgtttaatacatttacaaaatccttagtctttggtgcgtcgaaagctaagctatcaactgcaactaagctgttgtctaagaccttttgtgaaaggacagacttcaaagctaagcgcataaccttcttaggtaatttgtaactgtatgaacgaggggttggtccgaagacaatcccacctttacgccattgtggtgaacggatagaaccttgacgcgcacgaccagtacccttttgacgccatggtttacgaccaccaccgcgacgagcactacggttcttaactgcgtgagttccttgacgcattgatgcacgttgcatcaagatggcatcaaaaaccacgttttcgtttggttcaacaccaaacacagcgtcgttcaaagtaacgtcaccattttgcgtaccgtcttgtttaaataatgctacgctagtcatgtattatgtcctccttccttatttactcttaacagatgttttaactgttacaaatgacttgttggcgccagggacattccctttaattaataaaacgttgttttcaacgtcggcacgaacgatttgtaagttttgcatcgtacgttggtgattacccatccggcctggtaatttcttacctttgaatacccggttgatgatggcacccattgaaccaggacgacgatggtaacgagaaccgtgagccattggtccacgactttggccgtccttatggatattaccttggtaaccatgacctttagtgatacccgtaacgtcaacggcgtcgccagctgcgaaaatatccgctttgacttcgtcacctactgtgtaatctccaagctcaacattacgaatttcacgaatgaagcgcttaggagtcgtttttgcttttgctgcatgaccttgagcaggtttgttcgtcaagacttcgcgtttgtcgtcaacacctaattggattgcttcgtaaccgtcattttcaacggtcttaacttgcaacacaacgttaggttgaacttcaacaactgtaacgggaactaattcgccgctttcagtgaagacttgcgtcattcctacctttttccctaagattcctttagtggtcatgagtacacctccaattaattgattttagtttagtaaattaaagcttgatttcaatatctacaccgctaggcaagtctaacttcattaatgagtcgaccgtcttaggcgttgggttaacgatatcgattaaccgcttgtgagtccgcatttcgaattgttcacgtgagtccttaaacttatgtggtgaacgtagaacggtataaatagtccgttcagtaggcaatggaataggacctgaaatagtagcaccagttctctttgccgtttcgacaatcttgtcagctgactgatcaagaatgcggtgttcgtatgcctttaagcgaatacgaattttttgctttgccattgttgtgacctccttcgtctattttgaaaataagactagctccgtgaaaattaccgccacgtcccatgacaatgtggccgggcgtgtcgcaacctttcacatcaaagctaactacgactacttgatgatggggatatagttatccccttctaaataccaagcacaatctataataaatgaaaagctctgtaatagcaagtgttttcgcactttttttataaccatcgttgtaaaccgtgttacctttttgaaccagctcaattaatgtaacacaaattccatccaattaatagcgtttgcgcctaatttctttttggtgagcgctttacatttctcactgccgaccggccacgatcatgtggacacctactagattgcattaacactttctcaggaacaagacccgcgttcagcgtcatacatttttgtctggagtcatttaatcggacttcaacacgcttaattcaaccgctcctacatctgacggcgccgtcacactgacccacgttcttgttcatctaccttctattatattgtcatctgcttaccaccgaccgtcagcaccttggccgtggtcaccgacaaccgtcaactcatgtggttatctccggtacaaaaaatgtgatgttgtccgcgttctccttattatgctatgagtctcgcaccctttaatattatggctgccagttttatggtcgcagcggctagtaacttaactagtgcgacccttgttgcgcgattgtacccttgcgcgatgacacaggcctgagcagcactgtgctcgtcacagccgtacccaatgccagtgacggccaaactatcccaagccgcttcaattgatgtgccacgttgtcttacgacgagcagtaatcacatttagttcgaccagaaatttatgtaaaaaaagaacgtccagccgaagctgaacgtccttcttattatcaatcaagcttatttggcaggagtgccgccattcttcttgatgatatcttcttgaactgactttggtaccttttcgtaatgatcaaaggtcattgtgaaagtcccacgaccttgagtagctgaacgtaatgtggttgcataaccaaacatttcagccaaaggaacgtatgcatgaacttcttgggcattcccacgttcttccataccttcgatgttaccacgacgagcagtaacgtgacccataacatcacctaagtaatcttctggggcaacgatatcaaccttcatgataggttcaaggataacagggccagcagtcttaacggcattccgcaatgctaatgatgcggcaatcttgaaggctgcttcactagaatcgacatcatggtaagaaccatcatagagcttagccttaacgtcaaccaaaggataaccagctaacacaccgttagccatagcttccttcaaaccttgttcaactgaaggaatgtattcacgaggaacaaccccaccgacgatggcatcttcgaattcgaagcctttaccttcttcgttaggtgtaaattcaacccaaacatccccatattgacctttaccaccagattggtgaacaaacttaccttgaacttgagtgctcttagtaaaggtttcacggtatgaaacttgaggcgcaccaacagtggcttcaacattaaattcacgccgcatccggtcaacgatgatatccaaatgcaattcacccatcccggcgatcaaagtttcaccagtttcagggttagtttcagccttgaaagtaggatcttcttcagaaagcttttgtaaggcaacgttcatcttatcttggtcagccttagtcttaggttcaacggcaacctggataactgggtcagggaattccattgattccaagtgatatggatggtcaatcgaagtcaatgagtcaccagtagtcgtgttcttcaaaccaattgcagcggcgatatcaccagagaaaacttctgggatttctttccgttggttagaatgcatttgaagtaaacgaccaacccgttcacgtttgtccttagtggcgttcaagacatatgaaccagattccaaagtaccttggtatacccggatgaaagtcaaacgaccaacgaatgggtcagtagcaaccttaaatgctagggcagcgaatggcttatcatcaccggcaatcaagtcaacttcttcttcagtttcaggatcagtagccttgtatggcttaacatcaagtggtgatggtaagtagtccacaacggcatccattaacatttgaacacccttgttcttgaaggctgaaccagctaatactgggaagaattcaagtgctaacgttcctttacggatagcagccttaatttcttctttgctgatttcttcaccgccaaggtacttttccatgatgccgtcatcgatgtcagctaaggcttcgattaagtcatcacgtgcagcttgggcttcttctttgtattcatcaggaacgtcaaccgtatcccattcagtaccaagttgatcttcatcataaaggtcagccttcatttcgattaagtcaatgaccccttcgaaattatcttcggcaccaattggtaattggatggcgtgggcgttagcttgtaaacgatcatggatcgtgcttacagagtacttgaagtccgcaccaatcttgtccatcttgttaacgaaaacgatccggggaacgttatacgttgatgcttgacgccaaactgtttcagtttgaggttcaacacctgattgggcatccaatacggcgatcgcaccatctaaaacccgaagtgaacgttcaacttcaacagtgaagtcaacgtgccctggggtatcgatgatgttaatccggtggttcttccactgtgcagtcgtggcagcagaggtaatggtgatcccacgttcttgttcttgggccatccagtccatttgtgaagcaccatcatgggtttcaccaattttgtgaattttaccagtgtagtacaagatccgttcagtagtcgtggtcttaccagcatcgatatgggccataataccaatattacgggtcttatcgagtgagaattctcgtgtattagccattagaaaatgtgttactcctctcaatataaatggaattaacagtataaagtttatttcaaaaaatgactactatatgcgcgcatataatagtcacctttttgtgattagttaaaggcgacctttaaccatctcacggaaatattaccaacgataatgggcgaaggcacggttggcttcagccatccggtgagtatcttcacgcttcttaactgaagcaccagtattgttagcagcatccatgatttcacgagctaaccggtcggacatagtgtgttcgccacgtgagcgagcatattgaacgatccaacgaaggccaagagtcgtcttacgatctgggcgaacttcgattggaacttggtagttagaaccaccaacacggcgggccttaacttcaagtactggcataacgttcttcatagcttcttcgaagacttccaaaggatcgttaccagtttgttctttgatttgatcaaaagcatcatacaaaatagttgatgcggtaccgcgcttaccatctaacattaagtggttaattaaacgcgttactaatttagagttatacattggatctgctaaaacttcgcgttttgcaggtgcaccttttcttggcatttaacttacctccttattatttctttggcttcttggtaccatacttggaacggctttggcgacgatcttcgacaccagcagtatccaaagcaccacggataacatggtaacgaacaccaggtaaatccttaacacgaccaccacgaattaagacaacgctatgttcttggaggttatgaccaataccaggaatgtaagctgtaacttcgattaagttagataaacgtacacgggcatacttccgtaaagccgagttaggcttcttaggagtcatggtaccgacacgagtagcaaccccacgcttttgtggcgctgggttattagttgcaaccttcttgtaactgttatacccaaagtttaacgctggggcatttgattttgatactttagacttacggcctttgcgaattaattgattaattgttggcatgttctaaagtgtcctccttccaaatatctgttttttaagtccacacatccaggtggttcttttttgagtaaaaaagaatgcctggagcatggtaattgtgcgcttagccgaccagtcagcatgtctgtattcctgatacaggaatctgtctgcaaaaagcacctttactagactatcatgacatgccgaagttgtcaataaatgtcctgaaaaaatagtgatgctttacattgcgtaactagtgatgaaaggtggtccttccatgttaaccagcagtctttttattattggtctctgtctgggctcattcgtgacctgtatggcggaacgcatcagcaacggacacatactcattagcactcaacgatcacggtgtccacactgccggcatcaattacggttctggcaactgataccattactcggcattctgcttcaacgggggcgatgctatgattgtcgcactcctatcagcctccgttccagtctgattgaattactttgtggtagtctactagcttctagcagtacgtcattgtcattgacgctgccacttctgattggttacttggtattgattttcaatagtcttactgattatctcacttttgaagtctacccgctgacattacttcttccagccggactgggcttatggcaacaacggccacccctgacgatcagtctctacctcgtacttgccttactagtcggactatacttgctggcccagctaactgccacctttggtctcggcgatgttgacgttctactcatgctcgtcttcatcattccagccgacacactgttgacctgtctcgccattgcggccgttgccgcattagttggttttatcatcagtgccccacgccatcgcttaccattcgtgcccttcatcagttggagcttcatcatggtcacccaactcacgggtctcgcatagcgagctataattgcaatgttctagtacgcccgattattgcttgttagtcagtacgcgtcctgttcggatgaacgaccactcaactggtacaagttgtcgtcgaattgtttactacttggaactttaaacaagcgttaatatcgtatcagttgttctgaccctcagtagtaatatggtgatttagaaatcggggacagctcacaattctattattaccctgaaagttccccgataagattccggtctcaaaaaagtaacgactaatccgtcaaaagttgcgtacgcacgtgcccaccattcgaacaccatcccgagcggaagacgtttcttagcactacaagagtgtgcggtttagacgggctgagactgaggattagtgtagctaaccgaaagtctcattctgacctgaacacgtttcaccaatatagtattaaggtacggcagtccagcaattagcagaaatgcttggagcgcggtgcaggacacactaactaagcaagtttacacaaacttgaacttttccagcaaggctcagttagtcttctccccctgaagatcagccttcatcgccgaacgccccagatagcttacctacaatcgtgcatacaaaaaggacgaccacaatggccgccctttttagttacttagcaattacttgctagcatcttgttcttgcatttgtttttcaagatcgctgattgagtaaaccccatcagccacgttgccaacttcctttggtttgatatgacggtaaaccggcataccagtcccagcaggaatgatcttaccgatgataacattttccttaagcccgatcagtggatcgttcttaccacgaatagcagcatcagttaagacccgtgtcgtttcctggaatgaagcagctgacaagaaactattcgtttcaagagcggctttagtaatcccaagaatgactggccgtgacgttgcaggaataccaccagcaatcaaggtcttgtagttctcgtccttgaagtctgcaatatccattaacgtcccaggcaagacgtcggtatcgcccggatccatgacccgaaccttccgtaacatttgccgaatcatgatttcaacgtgcttatcgccaatttcaaccccttgcatccgataaaccttttgaacttcacggagcaagtagttttcagttgataagacatcacgcacttgaatcaattgcttaggatcgatcgacccaatgttcaacgcagcaccacggtgaataaagtcgccctcactaaccgccatccgtgctgttaacggcaacgtgtaagtccgggtatcagtttcacccttaaccgtaacttccttcgtccgttccgctggattttcttcaattaattcaaccgtcccagtaacttctgagatttcggcacgccctttaggattccgtgattccacaatttcttgcacacgaggcaacccttgggtaatatcgtccccggcaacaccaccggtatggaagttccgcatggttagctgagtaccgggttcaccgatagactgtgcggcaactgtcccaacagcttcaccaacttcaacttcatcaccagtagccatgttacggccgtagcaatgttcacaaaccccatgcttagtgttgcaagtaaatgcagaacggatcgtaacttccgttacaccagcatcaacgattttatgagctaagtcttcgtcgatcaagacgttgttaccaacaatttcatcatgcgtttcaggatcaaagacagtcttcatcgtgtaacgacctaagatccggtcatacaacggttcgatgacttcgttaccttccatgattgcgtgaatccgcaacccacggtcagtcccacaatccttttcacgaacgataacatcttgagccacatcaaccagacgccgagtcaagtaacctgagttggcagtcttaagcgccgtatcggtcatccctttacgagcaccgtgggttgaaatgaacatttccaagacagacaaaccttcacggaagtttgaaaggattggtaattccatgatcttaccgttaggggcagccatcaaaccacgcatcccagctaactgagtaaagtttgaaatgttaccacgcgcaccagaatcactcatcataaagattgggttatccgcgttgaaactttcaatcagtttttgttggatttggtccttagcgtcgttccagacaccaatgacccgttcataacgttcatcatcagtaattaaaccacgacggaactgtttcgaaatcgtattaacttgtttatgggcttcggcgataattgctggtttttctttcaaaccagtaatatcggcaaccccaaccgtcaaaccagacttagttgaaatgttgtaacctaagtccttcatccggtcaagcaagagtgacgttgctgtcacgtgatattgcttgtaaacttcagcgataatgtcggccaagaagcccttcttgaatggtggaatgatttcctgggtatccaagaattgatgaatatcttcaccaggcttcaagaaatacttgtccggtgtaccagcaatcaagttatcgttagttggttcgttcaagtaagggaacttgccaggcaaaatgttgttgaagattgccttaccaaccgtcgtgactaagactgcttgcttctgatcgtccgtgaatggcttgtcaggcattgatgagacctgaatgccgacccggctatgcaaatgtacataacctgattggtaagccttttgcgcttcattcaagtccttgaagatcataccttcgccttcacgaccgatttcttcagtcgtcaagtagtagttaccgataaccatatcttgagatggcgtaacaacgggtttcccgtccttaggcgccaaaatatggtgggcagccaacattaagagccgtgcttcagcttgggcttcatctgaaagtgggacgtgaatagccatttggtccccatcgaaatcggcgttgtaagcttcacaagccaatggatggagccgcatcgctttaccactaaccaagacaggttcgaaagcttgaatccctaaacggtgaagcgtaggggcgcggttcaagagaacaggatgttccttgatgacgtcttccaacacaccccagacatcgtcatcggcatgttcgatctttcgcttagcattcttgatgttagaagctaattcacgtttaaccaattccttcatgataaacggtttgaacaattccaacgccatttgacgtggcaagcccatttggttcatcttcaagaaaggcccaacatcgataaccgaacgaccagaatagtcaacccgcttaccaagtaagttttgacggaaccgcccttgcttccctttcaacatgtgtgaaagagacttcaatggccggttaccaggaccagcaacgggacggccacgacgaccattatcgatcaacgcatcaacggcttcttgcaacatccgcttttcgttttgcacgataatcccaggtgcatttaagtccaacaagcgtttcaaccggttattacggttgataacccgccggtacaagtcgttcaagtcagaggtggcaaaacgaccaccttccaattgaaccattggccgtaagtccgggggaataaccggaattgcgtccattaccatccaagctggttcgttaccagatgtcacgaaagcttcgatgatatcaagccgccgaacggcccgggtccgcttctgaccagaagcatccttcagagtttcctttaaatcacgtgcttctttttcaagatccacgttattcaataaccgtttgatggcttcggcacccatggcagcttcaaattcgttaccatattgagccttcttctcacggtattcacgttcagaaagtaattgcttcttttcaagtggcgtattaccagattcgataacgacgtatgaagcgaagtaaatgatttcttcaagtgcccggggactcatgtctaagactaagcccatccggctaggaattcccttaaagtaccagatgtgagtaactggtgcggcaagttcgatatgacccatccgttcacgacggactttactacgagtcacttcgaccccacaacggtcacagacaatacccttataacgaatccgtttgtatttaccacaagcacattcccaatccttagtaggaccaaaaatccgttcgtcaaacagaccgtctttttcaggtttcaatgtccggtagttaatggtttctggctttttgacttcgccatatgaccagctgcgaatcttgtctggggatgccagaccgatttgcatgctttcaaacttgttgacatcgatcaaaggaccgacctccctttttattgattatcttgctgagcgttggttgtttcagaaggcttagcggcgtcagcttttgcggccttgtccgcagccttctcatcttgttgttgtttaaacttgctgagtgcatcgacattgacaacttcatcgtcatcatcatccatgtcccgcaattcgatttctttgtcttcagaatccaagactttcatgtcaagaccgagtgcttgcaattccttaaccaacacgcggaatgattccggtacgccaggctttggaattggttcgcccttaacgattgcttcataggtcttaacccgaccaacaacgtcatcggacttgtaagtcaagatttcctgcaaggtataagctgcaccataagcttccaaggcccaaacttccatttcaccgaaacgttggcccccaaattgcgctttcccaccaagtggttgttgcgtaaccaaagagtaaggtccgattgaacgagcatggatcttatcgtcaaccatgtgactaagcttcatgtagtgcatgaccccaacagcgacccgcttatcgaacggttcaccagtccgaccatcatagacgatcgacttggcatctgaatcaaccccagcttcacgaatggcttcccaaatatctgtatcttgagcaccatcaaagacaggcgttgccatgtgaattcctaacttccgagcagccatccccaaatgcaattcgagcacttgcccgatattcatacgagaaggcacacccattgggcttaacatgatatcgattggtgtcccatcaggcatgtacggcatgtcttcttcaggaaccacgattgaaaccgtccctttgttaccatgccgaccggccatcttgtcaccaacttggatcttccgcttttgtgcgatgtagacccgaaccatcatgttaacgccaggagataattcatcaccgttttcacgagtgaagatcttaacgtcctggatgataccgccgccaccatgaggaacccggagtgacgtatcccgaacttcacgcgccttttcaccaaagatcgcatggagaagccgttcttcagctgacaattccgtaacccctttaggcgttaccttaccaaccaagatgtcaccgtctttaacttcggccccaatccggataatcccgtcttcgtcaaggttcttcaatgcatcttccccgacgttaggaatttcacgagtcatttcttcaggtccaagcttggtgtcacgtgcttctgattcatattcttcaatatgaattgacgtgtagacgtcttcacggactaaacgttcattaataatgatggcatcttcgaagttataaccattccaagtcatgaaggcaactaatgggttttgcccaagggctaattccccaccttccattgctggaccatcggctaagacttcatcgttatcaacgtgatcgccaactttaacgattggccgttggttatagttcttaccaccgttagaacgacggaatttcattaacttgtaagtgtctaatgaaccatcatcgcgacgaacgcgaacttcgcgagcatcaacgtattcaaccgttccttcatgacgacaaatcaaggcaatccctgagtcatgtgcagctttatattcaatcccagtcccaattaatggcgcgtgaggatcaagtaacggcaccgcttgtcgttgcatgttggcacccatcaaagcacggttagagtcatcgttttccaagaaaggaatacatgccgttgcgacggcaaccacttgtttaggcgaaacgtccatgtaatcgacattttcgattggcgtttccaagttttcttccttgttacgagctaaaacagtgtcttcaacgaaagaaccatcatcattcaatggagagttggcttgtgcaatcacaaattggtcttcttcatcggctgctaagtagtcgatcttatcggtaaccttatgcgttgtccaatcgacacgccggtatggcgtttcgatgaagccgtaacggttgaccttcgcataagaagacaaactgttgatcaaaccaatgttagggccttcaggcgtttcgattgggcacatccgaccgtagtgggtatagtgcacgtcacgaacttcatatccggcccgatcacgagtcaaaccaccaggtcctaaggctgataaacgccgcttatgcgttaattcacctaaggggttggtttggtccatgaattgtgacaattgtgatgacccaaagaattccttaattgaagcaaccactgggcgaatgttaatcaattgttgtggcgttaccgtcgcagcatcttgaatcgacatccgttcacgcacaacccgttccatccgggataacccaatccggaattggttttgcaataattcacccacggaacgaatccgccggttacccaagtgatcaatatcatcggttgagccaagaccttcttgcaagttgaagaagtaattaatggaagcaatgatatcagcaggcacaatgtgcttgaacttcaaatcaatgttgccattaccaatcacgttcacaaccttttcagggtcgttttgtgaataaaccttaacaacttgtaagaccattggattcgtaacaacggcttcgtcagatggtgtgtaagtaaccgtcttaaagtcgtcacgttccaagtatggggatagtttagccatgacattcttgtcaatgaccgtatccttttgcgcaataacttcaccagtatcaggatcagctaatgtctcagctaacgtttggtccattaagcgcgtcttcatgcttaacttcttgttaaccttgtagcgaccaactggtgcgaagtcataccgttttggatcgaagaaccgagcagtcaataggctccgcgaactgtcagccgtcttaggttcaccaggacgtagccgttcgtagatatcttttaaggattcttcaacccgggagtcgtcggtgttcttatgaacgtccttttccaacgtcaacatcaaactgtcagtttcacccaacatgtcaataatgtcatcgtcagaaccatagcctaaggcccggactaattccgtcaatggaatcttccgcgtacggtcgatccgtacgtatgagacattcttggcgtcagtttcaagttctaaccaagcaccccggttaggaataaccgttgtgccgtagctaggacgcccatttttatctaattcttcattgaagtaaacgccgggtgaacgaaccaattgtgaaacaatgacccgttcggcaccgttgataataaacgtcccttgttcagtcattaatggaaaatcaccgaagaatacgtcttgcgacttaatttcaccagtttcatggttagttaaacgtagggtaacgtgcaatggtgccgagtagttggcatcatgttcacgagcttcttcgacggtgtactttggttctaataattgatagtcgacaaattcaagtgaaagttttcctgcgaaatcgtcgatcggcataatatcttcaaacatttcccggagaccttcatccaagaaccattggtaagaatcggtctggatttcgatcaagttaggcaaatcaagaacttccttgatacgtgcataacttctacgggtacggtgtttaccgtattttactaaatgtccggccaagttgttcaccccttcttattattccggaacccgccacctccggccaaatattacatttgtgttacaaatgcgtttttgaccgaattttaggcataaaaaaaccaaaaatagtcgcttaagttgactatttttggatttatattaacgagccgcacagacaatagattgcgcgttcgctcgagttcacggttacagacaagttataatatacatcgaataacgttagttgtcaactagtagacttctctgccgccattagttttctggttcactcgcaaccccgtataagatcatctttaaaagagtttgaacgcgggtccgctcgtcagcatgaggatcaccgatttgatgaaaactgttaaacagtggactcaagctggtgatatagaaattcgtcgccatctgtggtgtgacccccacatgtagttgcatgtcaggttgctcaaaaacggtttgaatcggcttcacataatcagtaacaaatatgccgcccaactcgcgaatatgttcatgcgttaatgctttgaaactggaatgaattaacgtgaagacatcagccggatgcttatgcgttagtaatagcgagacttctgttaattgatccaacggagaccaatccgcacggacttgaatcgcttcaatgccagccttgatttccgcaccgaccgtcgtaatgacagccagaaagatgacctctttatctttaaaatggtgataaagcgcgggctgcgtaatgccaatcgcattcgcaatgtcgcgcgtacttgtcgcatcatacccatttcttaaaaacagttcccgggctgtgtctaaaatcgcctggtgcgtcttcgccatctgttcggctcgtgtcgccatgttatcatcttctttcttgactttatttcctattataatttacaccaatcagcaccgaaccaccagcctcagatcctacagttcacttcagtgggtagcatcttaataccgattgaacctaaaagatgacgcctgaagtggactaccacttcaagcgtcatctttaatttaatcgcgcctactttgaggaaacggtcgaacgaccatctgccttaggctggtttttaatattaattgtaatggtacccttgctagcaccaatcgtaacttggtcatcgaccttgatcgcgccggtcaataattcttcactcaaccgatcttcgatttcagtctgtaatgcccgtcgaattggtcgtgctccgtactcagggtcaaagccagccttcgcaaccacgtcaatggcagccggagtgattttgatcttgataccttgttgggccactcgatcaacaatttcttgtgacatcaacttaacgatttcgtgtaattcttccttattcaatgaatggaagacgattgtttcgtcgatccggtttaagaattctgggcggaacgtctgttttaacgttgctcgaatcgtcgcagcaaccgcattgtagtcattggccttatcagttgcaccaaaaccaactgatttttcatcacgaagtgtggttgccccaaggttcgacgtcataatcagaatcgtatttctgaagtctaccttccgacccttagaatccgtcaagtagccgtcatccaaaacttgtaacaaaatgttaaaaacgtccggatgagctttttcaacttcatcaaatagcacgaccgagtatggtttctggcgaaccttctctgtcagctgaccaccctcgtcataaccaacgtaaccaggtgccgagccaatcaaacgactagtcgaatagcgttccatgtattcagacatgtcgatccgaatcatattatcttcagacccgaacatcgctgctgccaaggcttttgctagctccgtcttaccaaccccagttggtcctaagaacataaaggaaccaattggccgactcggatctttcaacccgctgcgcgcacggcgaatagcacgagccactgcggatacggcttctggctgtccaacaacccgttcatgcaaaatcttttccaagttaactaagcgttcactttcagatttttgcaattgcgttaacggaaccccggtccattcggcaacgacctgagcaatatcctcacctgtgacttgtaaatcatagtgtggtgttgccccctcagtcacttcggcgtcttggtcagcttcgattcgatctaggcgttgcttcagttgcatctcctgcttacgaatatcagcggcctgttcaaaatcttgtgcttcgatcgctgtttccttatcctcacgcagttgcgctaacttgtcctggttcttggatagcttcgttggttgatccatctgatcgatgcggactttagctgccgcctcatccatcaagtcaatggccttatcaggcaagaaacgatcactgatataccggctggatagcttgactgcttgatcaacagcttcatccgtaatcgtaacccgatgatgttcttcatagcgtggccgtagtccatctaagatttcaatggcttcgtcttcggtcggttcattgaccatgaccgttgcaaaacgccgttccaacgcagcgtcagattcaatgtacttttgatactcatttaaagtggttgccccaatcgtttggagttcccctcgtgcaagtgcgggtttcagaatattagaggcatcaatagccccttcagcaccaccggcaccaatcaaggtatgcaattcatcgataaataagatcacatggccatcgttgtaaatttcatcaatcacttttttcaggcggtcttcgaattcaccacgatactttgtcccagcgactaatgatcccatatcgagcatcatcaagcgcttatctgccatatcagttggcacatcaccggccacgatcttttgggctagaccttcggcgattgcagtcttcccaaccccaggttcaccaatcaagaccggattattcttcgtccgccgtgacaggatctgaatgacccgtttgacttccttggaacgacctactaccgggtccatttcttgttcactagctaattgggtcaaatcgcgcgccagagaatccaaggttggcgttccttcagtcttcttgccaccgcgattagccgcgttacccttgcgcttactcatggcgtcactgacacctagcttgcgaagaacgactttacgcgtctgacctagatctaagtttaaattcattaaaattcgcgaggaaaggatactttcatcagagagcatcgctaacaacaaatgttccgttccaatcttgttggcaccgagccgttttgcttcatcaccggcaacggacaaaatttctttggcctttggtgaatatggcaagtaagtatccttgccaacattgctcaacgtcccatagccagtgaaccgttcgatttcttcacgaatgtcatcttcactaacggcatattgttgtagcaccttattagcaattccattcttttcgatggccaatgctaatagcaaatgctccgtaccaactgcctgatgcttgaaatatttggcctgttcctgtgccagtaccagcacacttttggcactaggtgtaaataagttatccattgcgattcctcgctttctttagctttcgtaacgcaagtggttcaagattccgataattatccgggcccgcagactgttttctaaatcccggtccgttaatcctaacgtctcgtggtcaatcgccactaaaatcaattgcgcttctcgacgatttaagacgtcgtcctcgtataaactttggacgaccgcataagcatctcgttgtgtgattgaatcgccgatcacctgtatgagggcgtccaacacatcagcatcatcgaccaaattaaccttctcaatgcgaatataaccaccaccgccacgtttactttcaactaagtaaccattttggatcgtaaaccgggtcttaatcacataattaatctgtgagggtaccacgttgaaaaggtcggcaatttctgaccgtcgaatttcaacatgctccgagtccgccaaaatactttttaaatacttttcaataatatccgagatattttgactttgcatgtgcttcacccttttcattatctttgactaatattgactattattatacgaggataatggaaaaaagcaaagaatttcacccaaaccgcggactagcatgtgcttaacggttgttacagcatagcacgccaaacgtttgctttcaattgattcaaccgtttagaacctcataatgattaaattattaggtctccatattcattgaactacctatttaaaatatgtcaagttgagtcactcctcattgcaggcgatgggcactggtatcacaacgatgaacagcagttccgagactaatttctccgagctcatgactaacagtggctgttgccttgtcgggattatgagtcacaaccaccgtattcttcacatggctgacttagtgagtaacgtcgcaaaagtgtcccctgaccgttgaaacacccctgcttacaaaaaaggccataaaaaaaatccagccaaatgactggattagttggtttaaccgtaatcgggaaaacaggatttgaacctgcgacccctacgtcccgaacgtagtgctctaccaagctgagctacttcccgagaaaattaaataaaaagccttagcacttaactaagactgtgttaaacgatcgggaaaacaggattcgaacctgcgacccccctggtcccaaaccaggtgctctaccaagctgagctatttcccgatactaatgcacccagtaggagtcgaacctacaaccttctgattcgtagtcagacactctatccaattgcgctatgggtgcttatttaaaatgccgaggaccgggatcgaaccggtacggttatcactaaccgcaggattttaagtcctgtgcgtctgccaattccgccaccccggcaaattaaaagcggaagacgggattcgaacccgcgacccccaccatggcaaggtgatgttctaccactgaactacttccgcataataaagctattaaattgtaaatgccgactagaggattcgaacctccgacctcctcattactagtgagatgctctgccaactgagctaagtcggcatgtgcgggtgaagggactcgaacccccacgtcgtaagacactagaacctaaatctagcgcgtctgccagttccgccacacccgcatgatgttaatcatgccttgttgccggttcaaacagttcttactggtatgccttgacaactatttaactttatcatcatgttgaatacttgtcaacaacttttttcaaataaatggataaatatactttttactggataaacaagttatatttttccgacaagaaatattatagcacggtagccgaaaatagcaaaccctattttcaaaaaaaggtgaataaatttcagtaaacccagctttttcgcccttttgcgcctgaaatgttctcccgacattctgcccgtcccgcaattatttagtcaactcggccgttatttccactcacattttaaaatcgacagttccctttaatactcattaattatgcaaaaaaagcgaactcgcatcactgcgagttcgctaacttcatctcaattaaccttgtttttcaatcttcgtcttaccgtgcatatatggaactaatacatctggaatcgtaaccgtcccatcttcattttgatagttttccaaaatagctgcaacggtccgaccgacagctaagccactcccgttcaaagtatgaacgaattgcaatttgccatcgtcatcgcgatattgaatgtgcgcccgccgagcttggaaatcagtacaatttgaacaactcgagatttcccggtacttgtcttgttctgggaaccaaacttccaagtcatgtgtcatggcagctgtgaagctcatgtcaccagtcgttaacgtaataacgtgatatggtaacccaagtttctttagcaatgattcggcattgttggtcaacttctctaattcatcccatgaatcttctggtttcgtgaacttaaccatttcaaccttattgaattggtgtaagcgaatcaagcctttcgtatcacgaccagcactaccagcttcttcacggaaggctggtgataaggccgtaaagtaaactggtaatttttcagcgggaataacttcatcacgataatagttgactaatggcacctcggccgttggaatcaacgtcaaatcttgcgtcgtaatccggaaagcgtcttccttgaacttaggaaattggccggtaccgtacatagattcatcagtgaccatgtatggcggcaaaacttccgtatacccttcagcttcgtgctggtctaagaaaaagttgtaaacggcgcgttccagtttagcaccatcgcccacgtagtataagaaacgactaccagaaaccttagcaccgcgctcaaagtctaagatgcctaaatcttcaccgatatcccaatgtgctttcggcgtaaagtcaaaatgccgtggtgtcccgattcgacgtaattcaacggcatcttcttctttcaagctaactggtacgtcgggatggggcatgtttggtaaatgtgcagccatatcctgaacttgggcatcaactgtccgccgttcttcatccaacgtcttcacatcggcgctaactttttgcatttctgcaatttcggcactagcgtcttccttgttccgcttcttctgtgaaatttcgcctgaaacttggttacgcgtcgacttcaattgttcgctcttggcgatcaattcacgacgcttttcatcagcggccaataaatcatcgatgtcactcgcagcaacaccccgatgaccaagctgttcttttacaaaatctggattttgacgaatcattttaacatctaacataacgacgtctccttttcacttttaatcgtaaataaaaacagtctctcctcccaattgggacgaagagactgcgattcgcggtaccacccaagttcaggatcatgattaatcccacccttaaacggataacggccgtgccgtgcagtattacctgcccacattgtcgcgccggagtttcgactaccgattcacaccacccaccggttctctgaacgtctacttaaaaacgcgccgtgtttaatattcactgtctactataaaacattgattctaaaaaggcaactagcctaaactagccactttttcgtcgatcaaccgaatgacttccttacgcgcatccgcatcggcgacaaagtccagctgatccccgtcgatctgcatcttcgggctatgatcataattagcgtaccagtcgtcatagcgttcattcaaagtctgataatatttatataaatcaggatcttgatcaatttgttcgtaagaacggccccgcttttggattcgtttgagcatcgtatcaaaagaaatattgatatgaataagtaaatcaggactcttttgatgagacgcttctggcaattcctgcatcatgttatctaataatgaatcataaatgtcaacttcggtattcgtcgcccggccaagatcaccattcaaatgaaataataatgaatcttcaaaaatcgaccggtctaagacgtccagatcgttagcaaaagctgatttaatactgtctaaccgtttatttaaaaaatagatttgtaataagaaggcgtacttcttaggatccttataaaataacggcaaaatgggattatcatcaactgactcgtaaaacgctttagaaccaaagtggttagccactaactgcgttaaactcgtcttgccggcaccgattgttcctgacattacaagcatggggcgtctctccttttaatcacgtcaaaattttgattatctctaaaagcaacactacatattgtacgcacccacgtcttaaaatgcaatatctggtgagtcaattcagtaaaaaacttcgcaccagccacaactgcgacgcactagtcagcgatccaagcaactcactaacacacactgggttactacccaagccggcgctggtggcacttcagctttgagtgcggcctctgaccagcataatctgtcgtgaccaaataatactcagttgagacgaacccacattgctaaaccgaagacaatttaaaagcgcacgctagctaattcctaacgtacgccataaatggtattaattggggccatcaataatacggctagcttattacttggccgccttttctcgagcttgcagcaaactgacgtactgttcgagagtcaaattgtgcttagtcatgaattccgcactcgccttaccaacgtaacggaaatgccaagattcatagtcaatcccagtcgactgcttaccatctttagtaaagcgcaacacaaatccatagtccgccgcgtgattaatcaaccactgctgacccttgttcttgtcggatgatgacaataattgattaccatgagtgctgtaccagtgcgtgttcatgatatctgctgcgagaccagtttcatgctcactaccactaggaactgcgacatattctttagtcagctttaaggcttccttggctgattttccttgattctcataggtttgaatcgactgatcccaaacctctttttgataagcgactgaacgatacccagacacgattgttgctggatagccggctttttttgcccccgctagaaaggcttccaatggtttgacgatagaactacggacttcaataccatccacgctcgacttattaaatgtcatctcagcgcgcttatgccacttattgacgaccactaagtcgctatcggtcgatttaacgcctttcggtaaggcactaatcagtcgttgccgcttggtctgcgtcttcgtcgacttagcactcgtagaactactagtcgctttagacgtcaactggctagcaccacagccagccaggacacctgctaatgacactaatgctagacctcttaacaaatttctctttaacatctctctcgctgcctttctcatttcagcttagcatagtcatagccgactagcctattcttaaggataagtttgcgaatttttaatgattccatattctcattctatcaaattaccatagatatcagattagcgcaccctcaatttgccgcttgctatcattacaatcgtgcaagcccccactcataacgatccgccgtgaccatctgttgcgagcagtgttatcagcataaatcaggacacctaaaaatacgaccgcgccttgagttgacaggtccaactctcgccgtcaaaaaatgcgattgacccagtgtcaaccgcatttaatcaaactatcaaagtgcgtgcttaatcttgatggtgtcgtttgcgtgtcaaatcaaccttgtctagcggaatcatcttagtatgatagcgaatcttataatagacatacaagatgatgaataacgggatgctcatataggtcaccccaatagcctgccaatcaagcgttgcaaatgaatgtaagtcttgaccaataatgaccacgacacacaagataaaggcgaaccacgggccaaatgggaaccacttggcatggtaccgcaattcactcaattgatgcccctgcttaacaaacgcgcgacggaaacgcagatgcgaaatagcgattcctagccaagcgataaagcccgttaacccactggccgaaacgaggaaaatataaatccgttcaccgaatagactcgacaagaacgtgagtaatccaatcaccgtcgttcctaataatgccatgattggaatcccacgacgattgacccgaccaaatgtcttgggggcataaccctgtaatgacaaagaatataacatccgtgtcgaggcgtacatccccgaattagcagctgacaatacggacgtcaagatcactgcgttcatcacactggccgcagccgccaacccagcccgtttaaagactaacgtgaacggactgatggcaatatcgctcgctgatgaccctagaagatctttcgacgtataaggaataatcgccgcaatcacgaaaatggctaaaatgtaaaataacaaaatacgccagaaaacttgtttaatagccgccggaatacttttctccggtgttgctgactccccggccgtgatcccaattaattcggttccttgaaacgaaaaaccagcgaccacgaagacactcaaaatcgttggaattccaccgacaaatggtgcctttttataggtaaagttactgaggccagtggcatgaccgcccatgattcccacgatcgtcaagacaccgataaccaagaatacgagcacggtcaccactttaattagcgaaagccagtactcagtttctccaaacgaccggactgacagcgcattgatcataaaaatcaagacgagcgcaatcagactaaaaacccaccccggcacggatggcaaccagaactgcatgacaatcgccgccgtactaatatcgaccgctaacgtgattgcccagttgaaccagtaattccagcccatcgcaaacccaagtgccgggtcaacaaacttcgtggcatacgtggaaaacgaacctgaaacgggcaaataagttgccatttcgcccagactagtcattaaaaagtaaaccatcactccaataccaacgtaggccagtaatgctccccctggcccagccgttgaaattgccgaaccggacgcgacaaacagcccggtcccgatactaccacctaatgcaatcatggataaatgccgcgtctgtaaggaacgatgcacttcctgatgttgtttttctgccattgcagaacctccaaaaatcgatttatatctaaaagtgttcacaccgattcaggttagcacaatcaaaataaaaagcctctttgcctcacgataacgtgcgcaaaaagactttaatcagattgattgacataattgctgatttcatcgtcgatagcgccccgcaactattctagctgcgacagtccatgatttattcaaccaaggcccaacggatgaatcggtcactgatccatcgatttcggcggttgccccgttcactgaccttcataagtggtgacccacttccagccggctactattgttaaccgcatcctcttctttcgatatactcaactattatatctgaccgaccatcttttgacaaccggtcactaatgttaattttaataaaactggtctggtaacattgtcttgcctaacgctttgttatcagaataatcaattggaatatccaccacaactggaccatccgtggcaaaggcctgatcaagcactttttccaaatcagcaggttggtttacccgcaagccagtcgcaccaaagctttcagcatacttcacaaaatcaactgggccaaagtggaccgctgcatcctcgccatacttcatttcttcttggaatttaaccatatcgtaggtgccatcattccagatcaaatgaacgatattttgcttcagtcgaacagccgtttccagctcttgggcggaaaataggaaaccaccatcaccagagacagacacgatttgcgtatctggacgaaccaaagccgctgcgattgcccaaggtaaggccacccctagcgtttgcatcccattactgaacaacaagtgccgtggttcatagctccgaaagtgacgcgccatccagatataatgactgccgacatcgaccgtcactgtcatgtcatcactgacccgttgttgtaaggctgcaattactgacagcggatgatttaacttggactgcttatcaatattaggtacgaaatcacgcgtctgaagccgttcttgtaattcacccaagtaagctcgcgcactatcgctaatatcatagcccttcatgtacggtaacaaaaagtctaacgtctgggcaatatcaccgatcaattcggtttccggttgaaaattatgatcaatttcagcgcgcattgcatcgataaccacgatacgggatttgccttccgcattccagttgcggggttcatattcaatcgggtcataaccgaccgcaatcactaagtcggacttctttagtaacatgtcccccggttggttacggaataacccgacccgaccgaagaaatggttggcttccaaatcacgtgaaatcacgccggccgcttggaaagtctcgacaactggtagattagcagcagccaccaagttccgaattgctttcgtcacttctggtgaagaagcccgcatcccaactagcaagaccggcaacttagctgctttgattttttgtgctaataacgtggcttcgaccgggctagcaggccctaacttaggtgcttggattggtgtaataacaggtgtgcgtacaatcgaatcagtgacatcttgtggcacactaacaaagctggcaccctgcttagcagctgtggcttcttggtaggcgtttgcgagcacttccgaaatgttttccggttcttgaacttccgcactgtactttgtaatcggcttaaatagtgccgcgttattcatactttggtgggtcaaccgtaacaagtcagcacgctgaacttgaccagaaattgccaagactgggtcaccttcagcagttgccgttacgagccccgtggctaaattgctggcaccggggccagatgttgtcatcactacaccaggtttcccagtaatccgaccgattccggcagcgataaacgcggcattctgttcatgccgcgtcacgatcaaccgcggacttttcgggttgactgggtgctccaagcgctcaaagacccgatcgatcttagcgcctggaatcccgaatacgtacttaacgtcgtggtttacaaggctgtcgacgatcgcatcggccccgtaatatttcttatctggcatgttgttcccctctatcttgtgaaattcattgttagaataccataaaaaacgctttaataacagcattttcagccttgtgaaataaagtgtatcattttgaaaatgatccccgattggcaaaagcgcgtcaatattggtttaccaagcgaaaccgctcccaatttttatcgagtttgtacgacgtctcacttatgtgcccgcatccgactaagcaacgcatttaattgggccattttatcatctgagtaattcgtccaatccaacactgggatttgagtaacaactaataattccttgatcaacgtcgccagtttttgctggtctaaaaaatctaaccataattgatccgctcgcgaaaaaatcccgttgaccactttcgtcccttcatgagcgaccggttcaacgtccttaaatactcggtcaaaataaccataattcggaaaggtctgcaacgtcccctcgatggccgcgaccacatctgtaattgaaatgtcctcaggtgagcgtgccaagtggacacccccgttatttccactggtggacgtgaccagtcctgccactactaatttacgaataatcttacgaatatacgaagcggaaccaccaattcgctcgtgcaagacatccgcagtcaacggaatctccggttgctgtgtagccaacaataccaacacgcaggcggcctgttcaaacgattttgcgagttgcattaactcacctcctaaaggtttaattccacacaatcaaagaataactccgtctgaccagcgccaaacggggcgtaatctggatggcgaacagcatcatactgtcgaaaattagcatgctctaagattcgcttagacgccggattattagctagacaactggctgtgatccgccgcaaatgaagcgtttcaaacccgtatcgtaaaatacgtgcaactgctgccgtcataatgccccgcccccaatatcgagcgttcaacatatacccgagatccatctctaaagttgctggttcgcccgtattcgtcatgcgctcatacaaccccacactgccgatcacgcggtggatcgctgttagttcaatcgcaaaaatctgtggtaacttcgcttgttgtttcaataagaattcggcttccactaagctgtgcgctggcgtaaagcccgccgatgccgcaattgacggatcacgaactaagtcataataatcctctgtatctaccaacgtaaatggccgtaactcgagttgctcattccgagttgtaaccgtaaccatgcccatatctgttccacctgacttgcgttataatagttatgttaaccatatcaaattgaggtgattgcatgcaagttattaagcaaaaattaacagcgacgtgcgcgcaattgaccggttatttgcatcaaccggatacgaacgcacaccaaacgaacttacccgccattattatcgttccgggcggctcatacacgcatattccagtggcgcaagcagagagtctcgccatggctttcgctgggcacggttaccaggccttttacttggaatatacgctactcactgatcaacaaccactcggattagcacccgtattagatttaggacgagcagtcaacttgcttcgtcaacacgcggccgaatggcatattgatccgcaacagatcacgcctgctggttttagcgtgggtggtcacattgtggcactgtataacgattactgggcgacccgcgtggcaactgaattaaacgtaacacccgccatgttaaagccaaataacgtggtactcggctatccagtcatcagtccattgctaggtttccccaaggatgacgcgaccttggctacctggacaccaacgccgaacgaactggccgctgaccaacacgtcaattcagataatcagccgacttttatctggacaacggctgacgacccaattgttccagcaaccaatacgcttgcctacgcgactgcgttagcaactgctaagattccttatgaactacacgtctttaaacatggcccacacggactagcccttgcgaatgcacaaacagcatggaaaccagacgccaatcagccgcacgtcgcccactggttaacattagcacttgaatggctagctgataatcgttagttcattaccagtcgttgctagttaatattttatagatgtaaacaaaaaatcgtttgcttcgatcaatttctcgcaatcagccgagtagtgtcgattaaagcaaacgattttttattttgagtctattattagtgacacggttgcctgctaaataatagattagtttaagtttgttaattgtctttataaatatgagcgataaaacaacggccatttcagtaatcctggtgcccagaaaacgtagaaccattgcatgatttgactccaagaccatgccaacaacacggccccaatcgtatcagttggataatgtgcattcaagtaaatacgtgagaaaatgaccaatactaaccatacgacactcacccacttgacgatcattgccattcgataacttggcaactcaggaacaatcaacatgataatcacgctgaccaacacaaaggttcctaaaacgtgaccactgggataactatatccggtatcctgcgctaaatgaccaattggtcgcgctcggccgatgatgtgcttgacaataaagcctaacgccattgcaccaaccatatatgctagcgtccagaacgcttgaatcttatatttaaatccgtacattagaaacgccaggatgacgatccacaaaatgtccattccgggtgacgccaaccaagcaatcaccttataaaataccgtccaaataccgctattactaatttggaccagcgacgttaaggccacatctagtaaatcaataccaaccgcgccgtcactaataaaatagcttaagtaggcaaataaaattaccccaatgacaaacttgatcggccgactacgcgacttatcgatcatcaaaacaagaacccccatttaatattaaaattaacaaaattataccatagtctattaatcgactgaacgaatcattaatatctctcagggaaccttaaaaaaaaacaaagaattcccattttaatcacgttttattaacaaaaaggttatgatttatctgacagtcatcggtaatcaagctaaatcttacgtggattcagttcccgctgacccgaaaaaatgctaaactatgaataactattaccattggaggaagagttcatggaagacatgccaagtcgctcagaaatgcatcgtgagaaatcacaaggaaacaattcacaggggaacggcaacgggcccaagaagaagcaccccgttcgcaataccgttttaatcattattgccgtgttattagttgggaccggggcctttgccgcgcgaacttattttaacgccaagaatgcggccgacaccgtcttcaagagtagtggtattaaaaagagtcggaatacgagcgccgtattgaatggcaagaaacccgtctcgatcctattactcggcactgataccggggctctcgggcggaactataaaggccggaccgatacgatcatcttagcaacgatcaaccccaagactaagacaacgaccctgatgagtttaccacgtgattctgaagtggctgtctccggtttcgaacaggacttcccgactaagttaaacgctgcctacgcttatggtagtgccggaacgaccatcaagaccgttcaaaaatggttgaacgttccaatcgactattacgccctgatcaacatgggtggcatgaaaaaagttgtggatgaaatcggtggcgttgacattactccaattcggacatttacctacgaaggttacacctttactaagggccaaaaagaacatatgaatggtgccaaagccttggcctattcccggatgcgttatgatgatccactcggcgactatggtcggcaacagcggcaacggcaattaatcaccgccattatcggagaaagcgccagtgcttccaacttgcttaaacaagatttcttaaattcacttgctaaacaaacacggactgacttaacattcggtaatttaactagtatcgtcactaattaccgtagtgcaaccaagaatatcgtctctgatcacgcccagggtactggtaagatgattgatggtcagtctttcgaagttgtttcgcaatctgaaaagcaacgggtcacgaacgtcttacgtaagtcccttaatttaaaggctgcgacaaccggcgaaaaatttgctaaccaaaactaaccatctgatttgatgataagagtcatgactacttgttgcgatgtctcagctaactaattaaaaagcgccaactgaactgcttagtagagcagttcagttggcgctttttctgtattgaatgcgagtcgtaataactaatctaagcgcgtaactattcagaacgctggcacacggcaaattagtcgcactaacccaccacttttggcggaatttatttatggtgcttagtcttagcgtccgcaaactttgttcacgattcacaactaatcagccaacagttaggttacgactccaatcggtgcaaccgccactggcgaatacaaaatgcgataagccggttgagtaattcagctaataagaatcccaatgcaatcgcaccagtaatcataatcacttgcaacgtgaatgaaaccgcctcacgataattacccagcgcaaagttacgcaccatctgataagcctgactgccgggcacgaatgaaactaaactcggaatattgaagataatagcgggcatcttcttgtagcgagctgctaagctgctgaggacgccaataccgaccgagccaattaagcttcctaagacgaccccaccatcaaaagcctgaacaatcaaatagccaccccacgttagggtaccaatccagcccgcaacgtttaacgcttgatgcggaatattaataatcaggccaaaccccagtaccgcaatgtaagccagcactaattgtccaattgtgcccatcatgatccctccgaatacccaggctagtgcccgtacttaaaataatgtaatgacaacggcgatcccaaagcctagtgctgccgcactcagcatcgcttccacgccacgtgcaggcccactgacgaaattaccagccagagtatctcgtacggcgtttgttaatggcactccgggcactagtggcatcaacgacccgataataatatcattgacattggttccccacccaatctgacacacccattccgcgccaaacccaattagaagtgccgccgttaactcgctcaaaaatttaattttaagataccggttaagcagataaaagaccaagtaacctaatgttccaataataacagttggccacgtattaacaatttcctgacgaaacataatcatcaaggggccactgactaaggctgcaccgaccaactgcaaccacaacggaaatgagcgcgaagctgcatctaactgattaagccgttgatataaagttggtaaatcaatggtcgtagccgcaaattcacgggataactgattgacctgtgccactttttcaagatcgatcgttcgctggttaaccgcggcaatctgcgttgcattacgtccttgaatcgacatcatgacacccgtaatcgtcacgtaggtattggcagcaacaacccccgcattctgagcaatccgcatcatcgtatcatctactcgcgaaatctccgaaccattctcgaccatgattttaccagccttcaagcaagtcgcaataatcatctcatcggttgtcactgtcatcccaccctttaataatcagaattacattctctaataattcttactttagccaatgtctggctgttagtaaagctttatttatgataattaagcatccgctgcaaaacgacaaaaaaccggtgatgagaattaattctcatcaccggtttaagccatttaagctgttaattatgcttttgtaacgttaactgcttgtgggccacgatcgctttcttcaacgtcgaagtttacagcttggccttcatcaagactcttgaagccgtcttcttggatagctgagaaatgtacgaatacatcgctaccgttttcgcgagtgataaaaccaaaacccttatcagcgttgaaccatttaactgttccgtgttccataataaaaaatcctcctagtgcattttgcacgtataaaataatgtaaatcatgattcggtacaaatggggatagtttattgaaacgatctgaccaaaattacctaaccaagctacaagaacaattgtagcatattgtttctaaaaagggtagccaaacaccatgatttccatgaaatgtttatgtgatgataaatgaaacagaataactaactaacaattaacaggtttgttcggaaataggtgccgcatgcttactttacaaagacattgtgcgccgctttatagctaactgggatttcctcgcccgttttctgaatggaaacggtaacagggccttcaaatggatcgtgctttaaaaccgtgacctgctgtccaatcttgagcggtgtatcatgcaaataaactaataaatcatgattatcaataaatcgctcaatcgtaaccgttgtgccatcctgcgtatctgctaaactcacatgactgtcttcctgataatgaccatccttatcgggaatcgcgccaccatgcggacaatgcgtcggattgcctaaaaaggcttccaaagaatccactagtcgttcactggtcacatgctccagcacttccgcttccgtatgcacgtctggcaaatcataatccaatttatcaactaagaaatcttcccagattcggtgcttgcgaactaacgtttcagcgtagcgaatgcctttctttgttaacgaaatcccagcatacggggtatgcttagccaagccttcctgaactaatttaccgaccatctccgttacagagccggccgcgatgtctaaacttaaggcaatttgcttattcgacaccttttttttcgtaccaccaagctcgaaaataatttttaagtaatcttccttcatgggggtcatgaatattcttcacctcaactaaatagttacttctgattctctctaatataattctaacatcttactacaattgagacaccagttctagtctctaataacgacaaagctttgaaataattgcctaatcgtgacataattaattgtagcgcaaaataaccaatttggttactaatttagaaacgtgcttgttcaactaaggaggaaccgcatcgtgaatgatgatgctcaattatcaattacgcaattggatagttctttgcagcacaaggcagttgaagactttgccgcattttacttaccactttttgacgctaacaaccttgaaatgatgtccaactatgatgttgccagctatatgacagacatcaatgaacaccttacttacggccgctacatgaccaaggctcagcgcttgagtgacaccgttagtttttcatttaccgcctacgtcaacttgattgatcgactcgatcaacaatactttactagtggtaatccagcactaccatggaatgaatggttagccgccaagtttgctcaaactgcgacatcttaacaattcctacttaattaacgcgcgctactcgtgattatttcatatagaagtagaattaatactaaatgaaagacaagcaccacgcgtacttatagattatttaaagagattgagttgatactcggtctcttttttgttgataaccacactgatagattacgttttaacgtacgaaagtacaaaaaagccccaagctttcccgcagcacttgggacctctggtaaatatcatcaccgggcgattgaagactactactagtttcaattacacgttgttttatgcacgattactacctagttctagctaggcatctctcagcgcttattcgcgctccgttgtaaatccttttgcaaagttaaacttcaaaacacgaccaacatgacaacggtcaacccagccataagatcggttgacgaacgggaaacttaaatgcccaagtgacttaccgacatttaccaacttaaatttaacattaattaatcggttacacaagctgaaggttgctagcgctctgacttaacgggataaagtcgataatgtggcgtctcatcttgaatataacaataaagctgttgtgtcttcgcttcgtcaaaatatcccaacttgaccatgtggtgaccatcccgttcttcgattccttgaaaagccgtcatcataaagatacgcatcatttccatttggttattatacccatcggcccgctcgacagccgctgccagtgtaaaaccctcgtctaacatcatcttgataaaatgaacacgcatcagcataccatacgaataacgatgcgtggtattcttctcactcactttaagactatgaatataatttttctgttcccagtaacgtagctgtgtctgagagacgccggtcatcttcgccaaatcgctaattccgattgtgaattgatgcttacccagctgttctttaaatttcttaaaaaatacaccgtcttcttgcttatccacgggtcaacctcttttctaacattttcaatactcagtatattatttttaatattaatgtcaagtttgttgacaaagtcgataaatccgattatattagacaacgtacttttttagagagaagggatttacttgtcaactcctgttgatacgcatgggaagccttataaccgtggcttgctcattgcagttttattagttggtactttttgtaccgttcttaatcaaacgattttaaccactgccttcccaacgttgatgaaagatttcgacatcacaacgtcgaccgtgcaatggttaacaaccgggtttatgttagtcaacgggattatgattcccgttagtgcgtggttaagttcacggatttccactaaatggttatatctttccgcaatggccattttcgaagtgggtactattatctgttggacagcaccaaactttggcttcttattggctgggcgtttgatccaagccgttggggtcggggtcaccatgccattacttcaaacgattatgctatctatcttccctgctgataagcgtggggctgccatggggactgccggaattgttatcggtttggccccagccatcggtccaaccttatctgggtgggttatcgacaacttatcatggcgtgatttatttggtttgatcgttccaatcgtcgcaatcgttctaatcgctggcttcttcttcatggccaatgtcttggaaacgtctaagccaaaattagactttgcatccttggtactttctaccattggttttgggagcttactatacggcttttcatccgttggtgacaatggctggacgtcaaccgtggttctctcaactttaattattggtgttatcttcatcattggttttatttggcgtcaattgacgatggaaaatccattcctccaattacgggtcttcaagcatgccgagttcacaattgcagctattttgagctcagttgctaacatggccatggtaggggccgaaatggttattccactttacctgcaaattattcatggtttctccgcctttgaatctgggctatcactattagctggtgccctaatgatgggggttatgagtccaattaccggccgggcctttgaccgttttggtgccaaacgcttggcaattttagggatgttcttactgacaatcgggaccattccatttgccttcattactcgtaatactgcaacggtttacatcgtggttctctatgccgttcggatgtttgggattgccatggtcatgatgccggcaactaccgctgggatgaacgcccttcccgttgaattaatgggtcatgggactgccgttaacaacacgacgcgtcaaatcgctagttccattgggactgccatcttgacttccgttttatcaaacgttacggacgccacaaaaccagctcacagcttgattaagagcaatccacttggttatcagaacagctatttcaacgcaaccttaaatggttaccacgcggctttctgggttgccgtgggcttctcagttgtcgggctcgtcgtagcgttcttcatgaaaggcaagcagcattccgttaagccagtaatgaacactaaggaggtgaacgactaatgattctcgtactactcgttgttagcgcaatcgcgctcttcttatcatttatctacgttcaccaaaacacgttacgaatcagcctatccgttatctttgcggcactcttagtgacctcgatcgtcttcgtctccaagaatgatggtcaacattacgggatggtcaaaacaacgacgaccaccacgcaatcattaaagtccgctggtagtagcaagcaacttgatttattgctctatcaaagtgtgggtaccgctgacaagcaccgggtctatatttataaaaagaccactaatcagaaaaaagttagccatacgacagccagcgtcaagactgctaaccaagttaagacgacgaccgcgacacctaagttagttactaagacgacacggtggacttataagagtaacgccatgaagttctggtttggcttagccaacaatgacaaacagttgatcaagcgaaccaactacttctatatcaataagaactgggtcgtacttagcacaacccaagctaaacaattcagtaaattgatgaagcaacagcaagcgacattaaaagcgcgtgctaaagtctacgtgactaatcaggtcaaggccgcaatggtcaagaacccgacaatgagcaaagcgcaactcgcaaaagttcaaaaagcagcggctgctcaatatcaagccaatgccattcagagcatgcttaaaaccgttaaagctagcaaataacttgaactaacaattaaaaatagctgacaagaccccggcatgccggggtctttgttgtctaaagatcatcatggcttgtcccccccctttcactaacgtcttgccaaaactagcgccggcgccccagcgtcaagaccacacttattcaaaatcgatgcgccggttaattatgccggtggtttacaaaaaattcacgtttcttttctgaaaatgtacactatctttactaaaacatgattttgatgctttcgagcaaatgatacgattatcacgtaccaagttgattgttacgatgtcattagaaagtcagacgtctaaaggaatgattacgtgtactatcactcaacatcaggattgttttggatcatcatcgcccttttactttatatgcttagtaaaacagcccctaaaaattttataattaagcaaataagacgatttggttggctgatcaacttggctattctgacttacattatcgtcaggcaaattcagcaacccactggcgtattacaaatcatggtcttaatagtcatcggattttcaacaatgagctcgatttacgctcgctttaaacatcagccttaatcaacgctaagataaaggcttgcccgtgagcaactggtactcagacatgttcggcaacaaactccacgtaagaaaacaagcgtccgcgttgatctaatcaacgcggacgcttgtttttatatcgcccataactgcattattaaaactgtcagacgatctttggtgattttaccgctgaacgactaacaactagccgacgcaaacagccggtcggccactgacggttgaacaggtgccgggttgagtaggctctcggcgtcatcgtagtcatcatcatcgtcatattgatcatcagtatcataatcgtcgtcatcagactcactatcagtatcatcatcgtaatcgtcatcggattgggtttcgctgtcatcggcgtcatcacgattcgaatcttcatcgtcatcatcttctgagtaatccgaatcgctgtcagcatcgctattagtatcggaatcatcgtcggtatcgtcattcgaatccgtatcttgatcactccaatcgtcatcagccgaatccgcgtcggtgtcgttcgtgtcatcattcgaatcagtcgtttgctcatcccaatccgaataatcgtcattatcgtcggcctgatcggcatattcgtcatctaattcttcagcagcatcatccacatcactatcgtcggcaaaaagtgccaaaatgaaccaatcgggcacatcgtctaatgcggccatgttccacttgtttttagcggcagcaatcttccgacgtaacgccgctgctcgtttcgcttcagccgcactaactttcatattcgtcttggccttttttgccgcagtcaataactgttttaccttagccttcaacggtttcaaatatggctttttatcccagttgatggctgcgcaacgtttgagcacgtccgctgaatagttgccgttcttcacctttaactgtgctttaacatcatctgacaattgctgatattcctgataatcactggttacggtgactttcaactgtttcagcttattcgtcaaacttgttgccccgttcgtaatcttgacacccttatcaaccgtcgtcagcgccgttttaacttttccggccttcaactccgatgtggtcgtcaagtaggcctgcgtttgatcccggtacgcctgtgccttttcatccttgggcttctgcgctagcgcgttatcaaaatacgtcagcgctttttggtatttattctcagcaaccgcatttaaccccttctcgattgactgcgaatacgccttgttatggcagccagctaaaccgaccaccatcaaacataacagtatcaataatgatacccggtgcttccccgatttcatccctgcttcactatcctttttggttggtatttatgcttcaataagtataccgttagtccctcaatcctgctagcccatataaattaatttatattccgattgaacatttaaaaaatagtgtccgctccaaaacaccaatcaggactaattatgattaacccgtgccgattaggtggattcctgttcgtcagccggtgcgcgtcctatgtcgacctccggggctgggtgacaattgctggaacgtaagccgacgtcgatttgagctaacgcataacccgcgtcatctcaaatacgagtcttattctaagccggaagcaacccacttccgactaagaataatttggctactgagcattgtcacccagcccctacggtcgggaaaccgctcgaatggctgatgaacgaccacctaatttggtacaattagtcgctgactattttgatgctggaagtttaaacaaagcgctaggtgcattaagcactctgtcaagagattaaatcctactacaccgattcaggattagtgagccatctcaatattatttttagtctgacagttgattgacaaaattaccgtttatgaaaagcaacgaccaattcatcaaaagttgggtacctcaccgtctgccattcgaatactatcccgactggaaggcgtttttgacaatgcccagtggtgaaaggccagtatttgagacgtggtttttcggctcaaatctgtgcccaccacgttccggcaattggcagaaatgcctggaggtcgatgtaggacgaaccaatctaagcatatttacgctaacttgaacttttcccagtgggtctaagctggctgcttttgaacttaagaatcggcacgttttaatcatgattgtttaataacgatgagtaataaaaaaacaatcgcaccaattctagtagaatcggtgcgattgtcttaacttacttatttattgagctgcacactgttcacaaagtggcattaaatctttcaaatcctcgacggatgagccattttctaagaagcaattgaccatatctagccaatattcatcatcggcgctaaaatgcgcgttgacatccttgcaaggtaataacccggcattggtataggcgacgattttatcagcagcgaccccgctatgggctgctaattgttccagagtcattttctctcaccatttgtcctttcaaaaaatcaatgtgattatgttacgcccccagcttttgaaatgcaagcaacaatttcgtaacgtcacgattaaaagtcaatgataattttcttcattattttcaccgaaagtagtaaactaattcttaacccgcctttgcctcattcgtcaccttactattggcggatatcaagcgtgctttttcatcataacacgcactcaaacttaacctacatagttatcctgtttcatgaaccacactaattgtcagataatcccatttagtgttggttaacgcatacttattgaatcggaggtcgtacatttatggattctagtttaacctttcgcgcgggcatcaaagatgtcattcccaccgtctttggatacattggcgttggcctagcaatgggcattgtcgccaacacgagtcacctatcagtttgggccgttctactcatgtcactaatcgtctatgctggttccgcacaatttattatcgtcagtatgctcctagcaggtagtccgatttcggcaatcgtcttgtccacttttttgattaattcacgcatgattttaatgagcatgtcagtcgctcaatatttcaaaaaagagtcgttattgcaaaatatcggactgggatcgttactaactgatgagaccttcgcgctcagcatgaacaagctcaatcagaccaatcaacaattaaaaacgagttggttacacgctgctaacattgtggcttacttagtttgggcagccgcgacagtggtggggtgccttttaggtaacttgattactgaccctaaccagttcggcttggatttcgccgttgttggtatgttcattggtttactttacttgcagatcatcacggatcgcagtaaatcattgccgacccagttgtgggtcgtactatttgtggccctcgccatgtattttctcatgcgttgggttccgggcaacttggctttgatctttgcgacgctactcggttgcggttttggaatggtggtggaccacaaatgagtacttacatttttgtgaccatcttactctgcggcctcgtgacttggctatcacgcattgtcccgtttgccatcattaaaaatctgtcagtcccccaatggctaatcagctttttatcatttgtgccaattgccattatgaccgctatttttgttgaaagtctgctcacctaccatgcgggacactggccagaatttaatctcccaaatatttatgcctcaattcctgccattcttgcaggagtgctcaccaaaagtttactagccgtcgttataacaggcatcgttgccatggccgtattgcgcctagttggctgggcttagagcgcaagggcacatctaatttaatattcccacttaaacgtcccgcaaatttgtgcatgagtttgcgggatttttctgtgactttttcagccataaggccagcaatcagcacctaaatgtgtcatgtcaataacggtcaattcgaactaaccaaatagtcagtagaaatccgctccgccaaggaaccggcatctaactgattggacgtttcgcgcaatatgaaatttttatcaatgaaagcgttccatctgcgcgctccgctttatcttatgaattaaagcaagtataatagtcaaagtgtacgtcgcggattgtcaagcataattatgacagacattggtaagaaaccgttataattgttcagagtgctttacatccgtgaatgaaacgggtaaattaacaacgaaccatctgtacacatatagtagataagaactgtctaaactttaaagattgagagatgaacagacatgtgcggttttgctggttgcttaactgatcggactaaagcggataacgcagcttacgatcagaccatccacgaaatgactaaaatgattgtccatcggggacccgatgatgacggttattttgctgatgacaacattaccatgggttttcggcgcttaagtatcattgacttagccggtggtcaccaaccactatcttatgataatgaacgttactggatgacatttaacggggaaatttataactacgttgaattacgtgaacaactcaaacaagaaggctatgaattcaaaacaagctccgattccgaagtaattcttgcgatgtacgccaagtaccacgctgacgcaacgaagtacttacggggaatgtttgctttcgtcatctgggataaacaagaaaaaacgttatttgccgcgcgcgatcagttcgggatcaagccgttctattacgctatcagtggtgatgacttctattatgcttctgaaagcaaggccatttacaagattttaaaggataaaaccttcgataaaaatgccttacaagattacatgacgttccaatttgttcctgaaccagaaacactcacaaaagaaatcaaaatgctcgcccctggttgctccttgacgaaaaagttggggtctgcaccacggattgatcggtattatcaccgtgaattccatccggtcgaacgttctgaagacgagtatgcccaaaagatcaaagatgccttaattgactccgttaagattcacatgcgttccgatgtaccagttggttctttcctttcaggcgggattgactcatcaatcatcgtcgcgattgcaaaaaacttcaacccgaaccttgaaacgatctccgttggtttcgaacgtgaagggtatagtgaacttgacgttgctcaagagactgctgaaaagcttggtgttaagaattacagcatgacgattacgcctgaagccttcatgaaggccttcccgcactttgtgtggagcatggatgatccgttggctgacccggccgctgtgccgcagtatttcttagccaaagaagcggtcaaacacgttaaggtttgtttgactggtgaaggcgctgacgaactcttcggtggctacaccatctatcatgaaccagaatcattgaaaccgttccgctacacgaaaccgattaatggtgccttgaagcgtatcgcactcatgatgccagagggaatgcgtggtcggtcattcttactacgagggaccaccccattagagaatcgctacgttgggaacgcctttatctttggtgaacaagaaaaacaagccttcttcaagaattacaatcagaaccatccgttccagtccatcacgcaaccgctctatgatgaatccgtcgactatgatccaatcagtcggatgcaattcatcgatatgcacacgtggttaaacggtgacctgttgcataacgccgaccggacaacgatggcacacagtttggaactgcggaccccatttgttgaccgtgaagtgtataacttagcagccgaaattccagctgatcttcgaattagtcacggcacaacaaagtacattcttcgtaaagcggtcgaagacatcgtgccagcgcacgtccttcaccgtaaaaagcttggtttcccagtaccaattcggttctggctcaaagatgaaatgtacgactgggctaagcagatcattaacgattcgcaaactgaccaatacttcaataaggactacttcttgaaactcttagatgaccacaaggccggcgttcgggataattctcggaaactctggacggtcctcaccttcatgatgtggcaccgactctatgtcgaatctgaccacttgatggatagccccgaagctaacgctgttgcggaaaaagtcgaggagttttagatcaatggaaattattgttcaaaagttcggcggcacgtcagtcaaggacgaagccgcccgtattcaagctttaaagcacgttcaatacgccgtcgatcagggcgataaagtcattgtcgttgtctcagcaattggccggaaaggtgccccttacgccaccgactcattactcggattagttggggccgagcactcccgcttaaccaatcgagaactcgacatgttggtctcagttggggaaaccatctcgaccgctgtctttaccgagttagcgcgtaagcaaggcctaaacgtcacggccatgactggtcatgatgctggcatcgtgactaacgacgattttcaaaatgcgaagattctccgcgttgatccgaaaccaatcacggacgcctttattgacgccgacgtggtagtcgtaactggttttcaaggtgctactgagagcggccacgttactacgattggccgtggtggttccgatacatcagcagccatcctcggcgccgctttaaaagcaaaacgtgttgatatttttactgatgtcaacggcatgatgactgccgatccacgactcgtcacccacgcccgcttcattaaggccatcagctacgaagaacttgctaacatggcccatgaaggtgctaaggtcattcatccgcgtgctgttgaaattgcagaacaagctcacgtgccgatgcggattcggtcaacttatcaggaacccgacgaattagggactttagtcactgaccggaccacgacccaaatcgaacattatcgtaccgtgacagggattgcacaccaaactgatttgacgcaatttactgttcctaccgatacgttaagttcaagtgccattttccaattgatggcacagcacggtttgagtgttgactttattaacattacaccacaccaagttgtcttcaacctggttgatggtgacgcggacgttgccaagcagctactgactgacgcgcacgtccattgtcagtcaattgcgaactgtgctaaagtttccgttgtcggtgctggtatcactgggacacccggcgtcactgctcggatcgtctcggcattagctgcacaacatatcgatattttacaatcgaccgatagttatacgaccatctgggtgctcgttaaggaagccgatttaaaagcggccatgaacgccttacatgatgagttcttaggaatcgaataaccatccctgcaagtccggcttaattgccgggcttttttgttgacctagattggcctggagatggcacgttcaaccagcagcacaccatgtaccgagcgattacaagcataatttcaattctcatttggggtgacaattatccggtttgcatgtattctagaaacagtaactttattgaaaaggacgctaatattatgcaagcaagtcaattaattaatagtttaaaattcaagcaggttcagcccgccttgaccacggactttgatgtcaccatgctgacgcaggatacccgcgaagttcagcccggcgccatgtttattgccgtcgttggttatcacgtcgacggccacgacctcgttgatcaggccatcgaaaaaggggccaagatcatcgtggcgtcaaaacctttagacgtcaacgtgccggtcatctacgttgaaaacaccgaacgcgctatggcaattctcgccgacgttttctatggggcacctagtcaaaagatgcgaatgattggggtgacgggtaccaatggtaagaccactgtcacccacctgatcgaacaaatctatcgtgaccagcagcaagccacaggcctcatcgggaccatgtatcgcaagatcaaggatgaaaaactgccaactgccaacaccacccccgacgccatcacaacgcaacggaccctagcggccatgcgggatgccggtgttgaaactgtcgccatggaagtttcttcaattgccctcgtactcggacgggtctgggggattgattacgacatcgccgttttcacgaacttgacgcaagaccatttggatttccacaaaacaatggctaagtacacggaagccaaggccatgctctttgcacaactgggcaataagtacagcgccgacggaactaataaggtcgctgttctgaacaccgatgatcccgttggccgtgaatttgaacagtacacggcagcgcacgtactgacatttgggctcaaaccagatgccatgatcaacgcacaaaatgttgaaatcaagagccatgggactgaatttgacctctccgtcttcggccacgtaacccacgtgacgatgcaactgattggccagttcaacgtgtacaacatgctggcggcctttgccgcagcttacgctagtggcatccccgaagaccaaatcattaagtcactggagaaggttaccggcgttaagggccgcttccaatccgttccttcccacacgggtgtcagtgtcatcgttgactactcacacactccggacggcttattgaatgccctagaaacgattcaagatttcgcgactaaggatatttattgcgtcgtcggctgtggtggtgatcgcgacaagacgaaacggccaaagatggctaaaattgctgtcgaacacagtactaagccaatctttacttctgacaatcctcggacggaagacccaaccatgattctaaatgacatggttgccggcgtgccaaacgccgacgtgcccgtctacgaagaccgccacgttgccatcgccaaggccattgaagcagcacaacccggcgacgttgttttaatcgctggtaagggccacgaagattatcaaatcatcggccggactaagcatcactttgatgacagtgaagaagctgctaaagcactagctttgaaaccaacgattgattaatggtcaaaacagaactgaccgacaaggctattttcaattctatttctgttaacaattgatgacatccgcgacacgcgtctttaaccattaacacccccagcaacagctaatttgattggccgttgctgagggtgttttttgcttgtttggctttctcccaaccagcgctacaaaacaggcatcagtcgtgtttgtacaaaagatgcacccacctttcgattattaaccagccaaactatcgcctatctttgataattcacctaattcggaaatataattatgttgataaaaggggttaattatcattgttagtttaagtttaattcgtttggggggatttataatgtcaatttttcaaacttggaaacgccgaattgcatacggttccactgacatggccggtaatattatttggcaaatggtcagcacttacttactgttctattacacaacggtcgcgggcatctcagctgcttttgcaggaatgctgttcttcgtcgtgcgcttcattgatgcgtttgatgcattgatttatggttatttgattgatcatacacacacgaagtatggacaatcgcgcccctactttgtgtggtttggcattccgttagggttgctggccatgtcgctattcatgattccatcatttggcggcaataccacaatgcgactcgtctacatttcaatcacttacactttctttagcctgatttattctggtgccaacacgcccattacttcgattttaccaagcttgactgatgatagcgttgagcggaccaagttagcgagtgctcggatggtcatgacaaccatcgggaccagtgcagtggcggccatcactttgccaatggttaaattactcggcaaaggcaatcagtcgaaaggtttcaccctctgggctattatcttaggcctcgttatcatgggactcttcatctttgcttttctcaatctcaaggaaactaacggtgcacaaaatccagacggtaccactgagtcagccgaatcactctcaatctggcaaagcttgaagggtgcggctagcaacaaaccatggctattattagcctgctcattcattctgctacaaaccttctggatgctacggggaaattcagcgatcttctttatcaaatacgtctacggtcggcctgaattagcgccaattttcctggggattggctttgtttccgtcatcgggaacctgtccgtaccattcctatcacaacgctttaagaaccgtaacgttttgcagttttcactcgtactgggcgttatcggccaactactgctgccaatcgctgaaaagatgcgtagtgtgagcctactaattgctggctccgtcattttcttgattgcgatggagatcacgttcacgattgtcttcgcgatgctatcagataccgttgactactcaacgaaagtactgggcctaaatgaaaccggattcttatctgccgtaccaatgattggcgccaaattaggaatgggaattggcggttttctagccggtcaatttctcgcatggggacaattcaatgccaaggcagctgtacagtccggacgaaccattacatttattaatctcgcttttatttggatgccgattattttattagccgcgatgattttcatgatgcaattctatcggttagacgaaaaagaattacaagccaacaaggccgacgcagcggctaaagttgaacctaaggaggatgttgaatatgatgccaacaattaattcgattcaaacaaccgtcaacggcgtcgtcaaaatcgttaaaccatttaacaacgacatcgccggtgaacaatttgacccgcacgtccttcaaacactaacggccttcaaacaaccagccatccttgaaaatgatctagcggcgctccgcagtgatagtttaacccccgccatcgcggaccctgttggtgatgcggttacagttcaaagtcgaaatattacggctctgaatcgcacggtcagcgttgaatggctgacaccacaaaatgtcattaatcacacagtactggtctacttccacggtggtgccttttacggcggtgttcccggcaataatacggtccttttaaagctggtcgcagctaaaagtcactgcgagattcttaatgtcgattacagcttagcgccagaagcaccagcacccgctggtattttagacgggctcgcgattttccaatatttggaacaacgtgacgctgaaacaatgattaccgttgctggcgattcggctggcgctaacgtcatcatggctgcaacaaatctgaatcaacaactcggtagcaatcgtatcaatcaacaactgctgttgtacccagttaccgccccaaatgctgaccacgccggtccactctgggatttggccgcctttccgattattgactcacagcgtgccattctcaccaactatcacgacctctttcggcaacttgacagcatcatgacggattattatgttccagagaactttgattcacattctccactcatctcaccgctacaccaggaaaacttcacaatgacaccaccaaccacgatcatggtcggcgagtttgatcccttccgaccacaagcttgggcttatgcacaacgcctggccgctgccgatactgcgaccacgtttattcagtatcagggcttgaaccacgctttcgcaccattagtggatcagtattggcaaagccaagatgtggcccaagtgatggcggccgcgttaatttagcgactagggcatatcaaaaatcactagtatcacgttgcagaaatcacatgtaaaaaacaagcggaatgataaaaaccgccccgcattttactatccgaaatgcgggcggtttcgcgttaagctaacatttaagtctgagacttgtgctatactcttggcatggggggattaacgtgaacaaaaatgataaagccaagcgtttgatgcaacaaatcgacgttgcctataatgatcctgaagttaaacaagacgcacaagttcgtgctgacttacttcgctatgctatggaacttgacaagaacggtaactatttattaattgccactaaagttaacggcatggcaatgcgcgtcatgcgtgatcacatgcaccaaccactccaagcaattaacacactctacacccaaaccgcccgcacctccgaatattattggggcgtggcggcagctagtatttttagtgggctgtggtaaagcactatcacgtgcgagcgctcactataaatcatattaacaacagttttgaaccggaacacagacaaataacttgaatcaaccgttaatttcaaagggacgctcctgacaaaccatgccagaagcgtccctttactaactacttaaaattttatcgatcagagtcaagttaacagctaaagtaaggcgttgtacttggctcagccatttacttcaagtacccggtttcattccaagtcgtcagttcaaaatgctgattatccgtcgtcgataacactgtcaggctatcattatccacgataccgtggcccactgtcttcataacttgcccatcgaccacaaaaggtgctcgtaattctgctacggggacacccattaacgccttgacagtcatcgtcgtcaccagaccgtgcgatacgattaatagtggttgcgtgctagctaccccaacttgatcaatcaaacgatgtagcgtcgaagtcgttcgggtgacaaaatccgcataactttcgccaccgccagctagttccggtcggtattcggcgggtttagtaaaaataacttgggcgtaggactgcggctgtacttccgcttcctgtttgccgtcccaatcaccaaaatcaaactcacgcaagccatcgtcgatttgaatcggcggttgccactgattggcagccacaatgtatttcgccgtatccagcgctcgttgctgcggactgctatatactgctgaaaattggatggtgcttaagtaatcaccagcggcttttgccccatcgattccgctagcaaccagcggggaatctgctcgtccaccttgaaatcggtgttctaagttatattgtgttcgaccgtgacgaatgaaataaatctgcatggcacgttcaccttcctaatccgttcaatagtttaattctaactgtgtcatgctcaatagaaaagtcttcagtgccataatgacgtaaaaaaataccgtggtctaagaaacacaccacgatatttcagttattatgataaaggcttaaccaagtgctggtacggatgtgtgccaatcatgagctgaccatccgggacaaaaccatgccggtggtataacttagctgcccggggattgccatcatcaacgtttaaactcagtttcgtggcccccagttgaccaacgagtcctggtaatgcttctagtaaggcactaccaactccgtgaccctgagcttgcggatcaactgccaacatgcttaaataccactcattcggccgggtctcaccacctaattccagtggtgcctcaaaccccgcatgatgacctgaagtcgtccgcaacaaatcgtttacagcgacttcattcttcgctaagtgcccaaacgcgacaccgacgattttgtgatccatgaccgccacaaaagtctgcgctaacccatctaaattggccggtcgctgatacaactcagtcaacattgccaataggtcggcctcgctaacattttttaagactggcatttccatatcacggtaaatcatcgcaatcaatggtgcaatttgagcactatcttgcggttgtgccgttcgaatttccatcatcacaacgctcccaactgttttctcaaccgtagcaaatcccgcggtcatcgtcaatcgttgtgcttaatttgttgccgatgttgaatcgtcatcacccacgtcgtgacgggaactaccaggataacgccaattaacgagaataataccattaatacttccgcaacaaatattttattattgataacactcccgaaggaataatgtaagcccgcaaaccagataaatagcgccaagaagccaccaaaaaagccgaaaaacaaggtattaaaagtcgtcccgataatctgcttaccaatactgataccatcgatatagagtcgcttagttggcaactgcggatgctgcgccagaatttcactcagaccagccgcaatcgcaatagcagcttccgcaatggcccctagtgtacttaaaattgcttcagttactgctacgccaataaaggagaccccaatggctaacgacataccttccagatcttcactatcttctaaactaaagccctgcgccatgatccaattttcaacgggaaaaataatcagcactaaaatgaccataacaatcaatgctgcaatataagctggcttggccgccacttcgttgtcctccccaaagaaaatcgtgaaggccaagatgattgtcccaatgaccaacgacacccccattgctggaaagccccatgaaatcaaaacaacggctaaaaacaacaatccaaagttaaataacaaactcaaaaaggccgtcgctccagtcttaccaccaattaatgtcatcaagcctagtaagatcaatcctaaaacggtaatcgtgttcataccatcaccgccttaggcatcaatcgactggctaaccaactggctactggaatcgctaaaacgataccgataccagaaatcaaactttggaccatccccaacgacatattcattgtaaaagtgtaaccccagctattgccgttacggaaatagagcaaagtcatcgcgaaagtatccgccatgaaaatcaaaaatagcacgttgatcaagggccccataatagaccggccaatttgaatacccgacttaaatacttgtcgtggtgcaatgtccgggcgctccgttttcaattgaaacaatgaagcaacaatatctgttgattcatccatgactgctccgagtgaaccgaggactgtttcgactaaaaataacggtcgaggaacctgcgtcacgtactgcatcgattcataagtcacaccacgctcatgggtcaccgcaaagacaatcaaactaataatgacagccagtcccgtgccaaccacagtcgcgcccaatgttactaacatttgacgactaaaaccgagcactagcaacagtgtgagcacggcgaagattacggccaatacgccaaagagcaggtaaatgtggccaccattagtagctaagtcgatctgaatggcggcataaaatagtacagcattgagtgcaacactcaaaaaggccatcagaccgctgaaacgcatgattagcaagagcagtgctagggctaaccacgcgacaaacgccaatgcggtatctcgttttaacccctgaatcgtcactgcactactatgatcactaggaatccgtaagaaaacttgattacggacgtgatacggctgatccattgcgcccgagcgcgtatacgtattcttgatctggtaagttcgaccacgatgtgccttattgagcacccggaccgttaccaactgtgtcaccgtcgcatccttattttcaaattcatccgtcgtcgtacttcgactcttagtctgcacgtgggtcacttgtgcaactgtctgctgataaagtcccgcattaacccgggtcaatccaaccccgattagtcctaaaacaatcaccagcagtgttaaccacaacccccaccgttgcttgattcgctgtttcacattttcaccttttttcacttcaatggtcaccagtttaccacccattccccaatacaaacttcgattctggcaatctttaacagaatctaagtttctacggtaatctaggccgttacttgaacgcgtaaagctttcagccaagcaatttcttcctcatcgtggaggcgctgagcaatttttagtcccttttcaatcaatgctagggcctgttcaggctgctgatggacccgccattcataaacggcagttaacttataatgagccaaaggttggtagcgacgtaataactgttgaacaccatcatcttgataccaggctatgatctgggggtcacgatgattggtgaccaagttccagtacaatgttgcatctaaatacttcgccaaatcagctggcggcaacgtattgaaacttggctccaagcgactcaaccccgctaacagttcgggggtgtccagcccatgttgaagtccccattccagaatcaaccaggcttgccggacgactaaataattccgattgccaccatcgcgcggcataacaatcatacttgtatcaaggtcacggacactaccagtctgaaccttaacggccgcagcacacgcagtgacatacgcggcggtcatcgccgccgttgattcgcgtgcctgccgaaattcctgtcccgccgtgggataaccgtgcaagttcattggtaataattgggcggctttcaacgtattgacccagatccaaataatgaacgcaaacaaccataaatcgaaactaaacttaaattgattcagagttattaaactgagcatgaccgtcagtaagttgaacaggccaccgccaaaacaataaatggcgtgattgaaccgtttggcatccgccgggggtgctgccacgatatgtggatgacgcgtcagcggtcgtcctaatttccaatgaccacgaacccgacttaattgaagtcgaaaaccggtaatccggacaattcgagcaccaattaatcgaaatccgacccactgaccgagccaatggattaacgtcgcacctagttcgctggcgactagtgccaatcctagccaaccgactgttgcaataaattgtccaaaaacttgcatgctattcctcctcgtaccttgattgacagcctttatttaacaaaattaattttgaaatcaataacacgtttttgggcatgacccatgattagtttttgacaaagttagattcaaaaaccggcagcttggatgcgccaaaaccgaaaccaatcacagcatgctgccaaataaaaattcatctaatttaacatgttttaattatggttcatacgcctggcaaccagtaccaagtgtcctcattttctaattcgacgataccatattaattatacgcgtggacactgaaataatcgctggtacttcgtaattgctcttattatagcaaaacaagctgacctccggcgattaagacgccaagcccagcttgctaatcaattgaattttaatgtcgttgttgctgaatgcacatgccgtattccttaacgacgccggtgtttaacaacagtgaagaaatgtaaaatcattgctaaaagaacgtaaaagacgacgacaaagacgccgtagtaggcccaaaaattgttcagcggaatcaattgttgaatccccgcttcgattcccattgtcagtagtgccattaccgcaatcatgaagaataattgaatataccgtttcaccgtactgtcatccctttcctttttatgtgcagcccgcgcgccgacccgttcacattctgcttgcttagcagctgtgatggtttgcataccccacgttttagttacgacaatctcccgtaatttgatgagaccacccatcgtcaaaaatttatcaagtgttttaaacgttgcgtcagtcacgccggtcaaataattttcaataccacccgcgtaacaatccgtgatcgtcacataatgcttgttcttaaagcgatcaggtactgcttcacccacggaattaaaccgtgcgatccgcccccgaaaacagtcacagaagtttttcattacccccgataagctccccaaataggttggtgcagctaatacccagacatccgccgccattaattttgcttccagcgcgtctaagtcagcattcggttgactatcgtgatctggtcgcaactcataatcgttgaggttgactagttccgtgtcagcgctggccgcggccccctttaagacggcttgcagtagctgggcagtcacgccatcagcgcgatgcgcacctaatattcctaagactttcacattttccactcccatcattcattcaaaagctatttttattttaacgcatttcaacataaaaatatggttatcaaacgaacagcaattgttaaacccgctaatagtacttacttttaacaaaaaggtttgacaatcgattaacgacttgctttaattatacataagtacgaacgttccaataacaattagtctaactgacaacttgtagacttaaagttttcttggctgcaactatttcaccagaacttgaacaatcgagctgtcataccaacacttaacaactaattcagcgtactgccgatggggggagttagtccttaagtgtaaattgaatttgaaaggacgcagtcaccatggctaattttcaacaatccgaaacggcacttattgaaagtgccacactaattaatatcttcgacgaaaaaattcggcgtcagattatcattgctctggggaacagtgataatggtctcaacgttactgatattaccgccttggtcaatatttcacgccccgccgtttcacatcatctatgcttaatgcgtgaagctggggtcattgatatgcgtagtaacggggtcgagcatatttattttctcacgttaaccgcaccattacagcaattacaggcaacttttgcgacgctaacggctgataacgcgccacttagtcagtcgtaagcactagcgcctcattcaatagtcaccgcaaccttcaggataacgcgagcctgcaacttacccgctaaacgttagcttgattttagacggttgccaaccaaaaatcggcactgccagaatgttcaacgcattctagcagtgccgatttttattaaccattcatccggatgatcactggtcctaaactgaacttagtcgtgattcaaggcttgcagatcagctggcaatgccgcctcaaagtgtaaagtctgttccgaaaaggggtcaaagaactgtaaactagcggcgtgtaaggcttgccgttgaatccacgccaagttaccgccatacagcgcatcacctaataaggggtgcccaagcgtcgttagatggacccgaatttgatgcgtccgtccagtcacaagttccaaccgtaaccgactcacgttatgctgcaattggtccgcctccacttgatacgtcgtaatggcgcgttggcccgccgtagtgaccactcgccgaggactgtcagccacccggccaatcgggcgatcaattgtgccactagccggcgtaatggtcccttcgatccaagcttgatacgtcttcactaattgcgccgcaattcggggctctgtcagcatcccctgcgccacccgatgtttagcaactaacacaaggccactcgtatcccggtccaaccgcgtgatcaggtgcggtcgttgattactggcatgactggctatcaaataacccttgattcgattgaccaacgtatcggtccgattactaggccccggcacgctggttaacccggctggtttattaagaacgagccaattagcatcttcatactcaatttggattggttgttcgctgacggctaccgctgtatccggtgcctcgtctggtagttgaattcccgcaatatcgccatcatgaatggtaataacgcccgtttgaacttgattattgacaagaaacgcgccggtgccatgcttgattgccttgattgttcgcatactgatggcatgcgtcgtcaagaatcgtttcattgccattgattgcccctggtgttgccaagtaaattccatacgtgttactccatttcatctcgtagtttaccaatcagccatctaatcagtttcctcatcggtgctagttgctgattccgcatgagctgccgctcgaatcgtcgccataaaggtttcaccatacttttcaagtttgctggccccgacccctttgaccgttaagaaagctgcgtcgtcttctggcatcaggtcacacatcgaatgaagcgtccggtcagaaaaaatcacaaatggtggtacgccctgttcttccgccaattgacgccgaagtgtccgcaactgttcgaagagggcactgttctctggtaccgtctgttgcaccttttgggccgtctttcggtgtaccgtggtcgttcctttaagcacggccactccactcgctgagactgtcagtgttggatactgaccacccaccgactgcaaataaccgctcgcagtcaaaaaatcgatcagttccacgacactcttctgtcgctgcccggacatcaacccgtacgtcgacaacgtattgaggttcgattcgcggacccgttgattattagcgcccgtcaatacctgggccacgacccctttaccgaaccgggaatgaagcctaacgacgcacgataagacttgttgagctgccgtggtgatatcctgtgattcccgctgatcagtacaattactacaccgaccacacggcgcggatttttcaccaaagtatttcaagataaactgttgtaaacagccctgggtattcgcataccgtgtcatcacctgtagcttctgatacgccaggtgtcggtgctccgtatccatctccgactcatcaataaagaagtgctgaagttgaatatcaaccggtcgaaaaatcaaaatcgcttcactaggtaacccatcccggccagcccgaccggcttcctgataataagcttccaaagttccggggacctgcgcgtgaatcacaaaacgcacgttactcttatcaatgcccattccaaacgcgttggttgccaccatgacgtcaacacggtcgtacaagaaatcctcttggttttgccgccgaaccgcatcatctagcccagcgtggtacggcgtggccttaatatcatgcttttgcaacaaactcgtcagacgcatcacttctttacgggtgctggcgtaaataatcccggcttcaccatgattaactttcaaataatctaaaatgtaacggtccgtgtcttggtccttgaccaccgtcaaatccaagttatcgcgggcaaaaccagtattcacttcatgttgtggatcgatcgctaagcggccgcaaatatccgcagcaacttgctcagttgccgtcgcagttaaagctagaacttgcggatgggtcggcaattgttcaatcgccgtgctgagcgctaaataactgggacgaaaatcgtgcccccactgtgaaatacagtgggcctcatcaattgctaacagttggatgggcaaccggcccagcgcttgaataaaataatccgaatctaaccgctcgggtgccacataaagtaaggtataatcccccgcccgtagttcttgaagccgttcgttaatctcttggaaatccagtgaactgttaataaaagtcgccgcgataccattatcatttaacgcgtctacctgatctttcattaaagaaattaatggtgagacaacgacggtcagcccctgaaaaagtaacgctgggatttggtaacataatgacttaccacccccagtcggcataatcgctagggtgttttcaccggccaacacttgttcaatcactgctttttgccccggtcggaattcatcatatccgaacgtggtctttaatacttgctgtgccgccgctaagtcaatcatcacacgtaaactccctctttgaattaatactctcattctaccgagaataccggcccatgacaagaacgcgccccggtaatcactaggtacgttaagtcgcacttgcgccacgaaaactatcaaaataccgaaaagtgcccgtccctattgattttataggaacggacactttaaagagaccgatattgattaaacgaccatgtcagattggccatcaaagggcactcgcccacacagtttatatgtacaatgctgacttagccttgcttgggtcggccacggtgatccaccaaaccttccatgccgtgttgtcgatattttcgtacccatgtatagacttgtggatacgaaacattaaaatgcttagcggcttctcgataatcgttgcaatggtccagcgtatactttacgatcgcaattcgttcttccagcgttgcgcgtcgtcctcgatccatgactcggcctcctctcattcactactattcatcataccaagagttctcaattttttgtagctttttccccgtgacttgcctgattcgttgcgatttttaataaattatttcgaaacagtccagtgcacctaacgctcatcttaaaataaatttgttaacgcagttattttgctcgcatttaagaacgtatgttcgtatactcgtattgaggtgattagcatgcagtcagaaaatctaaccgttaagtatttaaataaaagcaagatattaaagttggacccctttatgttgtacttacaagtcacgccattaaaggcgaccgagcctacgcccatcaactgcatcatcgtcaagcatgcattgactttattttaccaactccaacctgacgcacaactagcactctacggtcactataacaccaggcaccaattcgtgattaccaaattcatggttcgatctgcagtgcaaacactagccagctaatgtacaaagccgctaaaatataagtacttagatcagaggagctgttgtcgatgatgccaacgaacctaaccttacttgagcgtaagatctcaaataacttgaattgtctatactttgtcaaccatcccgtttaccgtattcaaaaggaccatcaattagcactcgcttcagaatacagccttgccggcaacgtgaccgaaattatctgtgatgaacagcagcgctatcatattttattcgtggcgcgtaaagaaattgtcttaactgaaaagaaggtcgctaaagtaaccaataaccagctcgggcaggataccgttcaatttctggcgacgctgggataccagtttccccctgcgcagccggccggtgaactaagccaacccacgatcctaccttcaccaacggaattgagtgaatgtccgaccgcttacgtaatcatcgactgcgagttcggcactcgctttcgtcgtaatggctccgctaaagccgtcagttggcacgtcatcgaatcacccgaattacgggctagtatcttccagctcagtgccatcggtttttcccatcatacgcagacagcgccttttttcaatcgttacttcgatgatcctaactttttacctgacaaaaagttggccggtttatcagcaactggcttaacgaccgtcgcttacgaggcgcaaggcgaccccttgacgattctaaaagcattcatccagcaagttatccagccacaactccccctcgttttttgggatcagacacaggacatgaaacacattcgattattactaactcagtattatcagcaattgacccccaccgaacagcagctagtcagtcgcccggtcacgatttttgatgcccaagcctatacgaataccttgatcaatcgtggcaaccataaggtcggtagccatgatctgccattaaatggcttagccgcactttttaatatcagcaatccacaccagcataacgccatttgggatgttcagacaactgaattagtcatggttaagcttgctgaactaactcaccaaacgccggtaatcactacaccgcctgcaccgatcgcactaccagctacggtgccagcggtggttccgtcaatccagacgcctagccccacaccacaacatgccagccacacgcaagttcaccagttacgggcacgtggcaagacttaccgtgaaattgcggcggtcaccggttttagtattagcgggattaattatattctcaaaaaagcccgttctatcccgacccgctcagaaagcgtataatgatattaatagcttaaaaggagtgttttaatatcatggaaaaacgtattaaaggttcatgtaccacgattctcgtcggtaaaaaagcctcaatcgatggctcgaccattatttcacgaaacgatgatggtcacgaagccctagaccccgaacgattagttgtggtcaatcccgcagatcaaccccggcactatcagtccgtcattagtaaggtcgaagtcgacttacctgacaatcccttacggtatacttcaattcccaactcaatcttgaccaatggaacctggccagcagcagggatcaacagtgagaacatcgccatgtccgcaaccgaaaccatcaccacgaactcgcgtatcttgggaatcgatcccttcgttgccggcggaattggtgaagaagacctttgcaccctagtattaccatacattcacagcgccaaggaaggcgttactcgtctaggtgccctgcttgaacaatacgggacttacgaaccaaacggtatcgctttttctgatcaagacgaaatctggtggttagaaaccattggtggtcaccactgggttgctaaacgtattcctgacgatgcttacgtggttgctccgaaccgcatgaatattgacgatttcgattttaacgctgatgataccttagcttcagctgaccttgaacaattgattgaagattaccacttgaatcctgactttgaccgtgtcaacttgcggcatatctttgggagtgcttcaatcaaagatacggtttacaacaacccccgggcttggttcggtcagaaatacttcacgccggacgttgtacaagatccaatggaacaagacttaccattcatctgccatgctaaccgtaagatttctatcgaagacgtcaagttcgttttgagttctcactttgaaaacacgaaatacgatgtttacgggagtggctctgaagctgacaaaacccttttccggccaatcgggatcaaccgtaaccacgatgtgcacatcttacagattcgcaacaacgtccccgctgctgttgccggtattcactggttagcctttggtgccaataccttcaacacggtcgtaccattctatgcaaatgtcaatgacacgccagctagctacaaagatgcggacggcacctttaatctcaaccacatgtactggttaagctgtacaaccgcccttttgggtgacaccgactacgacttttacgtggatatgcggaatagttacgaactcgaagccatgagtgcttaccgtaaaatcgagaatgataccgacgctgacttggctaaccaccaagacgtcacggcctatcttgaaacggctaaccaacaattggccgataccgcgatgaagttacaaactaaattactcggcgatatggtcattgccggttctgaaaaaatgaaattacgttataatttaaacgattaattaagcccggtagcttgcggttttagctaagatttttatggtgaattcatgagactaaactaatttatttttaatttagtggtttacaaataccagaatcgtgctaatataaatgtcacaagataaaaaacggaggaaagaggagtacgattagtcaacctgccagtgaatcgggagtgagtggaaacccgaccagaacttgactaatccgaaaaacactttcttagttgctaactgaaataacctcgttaaagtaggattagccgttaaccggtacgttaccatcggtggtgtatgtttgtacactattttaaagctggtttactgtaaggtaaacaacttgggtggtaccgcgaaagagtctttcgtcccttgataattcaagggatggaaggctcttttcttttatcctgtaactaaaatctgaacttattttaaaggagaccacgcatatgcatttaattattccaaaggattacgatcctaaattatccgttaaagaaacccaacaggccattcgttacattcgtgaaacgttccaagatgaatttgggaagcaactaaacttatctcggctttcagcaccgatgttcgttgaaaagaaaactggtctgaacgataacttaaacggtgtcgaaaaacctgtctccttcactatgcaagacatgggtgatgaacaaatcgaaatcgttcactcacttgctaagtggaaacgggtcgctttaaagcgctacggttttgatatgcatgaaggtctctacacgaacatgaacgctattcgtaaggatgaagatttagacaactaccactccgcctacgtcgatcaatgggattgggaaaaagtgatcagtaaggaagaacgaaccgttgaaactttgaaagccacggtacgtcaaatctttaaagtgatcaagcacatggaacacgaagtttggtacaagttcccacaagccgttcaccacttaccagacgaaattcacttcttaaccacacaagagctcgaagacatgtaccctgacatgacgccgcgcgaacgcgaaaacgccatttgcaagaaactcggctgtgtcttcttaatgcaaattggctggaagcttgattccggcgaacgtcacgatggccgcgcccccgactatgatgactggaagttgaacggcgatatcctcttctggtatgaaccattagaccaagctatcgaaatctcaagtatgggaatccgggtcgatgctgaatcaatgaagaaacaacttaaagacgtggacgccgaagaccggcttagcttgccataccaccaaatgatcttgaacgcggacgtcccttacacgatcggtggcgggattggtcaatcacggctctgcatgttattacttggcaaagcccatgtcggtgaagtacaagctgccttgtggccacaagccatgatcgaccaatgtgccgaacataacattcatttactttaatctgatttaaaatccaacaagaaggagtgatcaatatcatggaaaccattagtattatcaacgccgctgaccatgtcaatgaacaagttaaaattggggtgtggctcagtaataagcgttctagcggcaaaattgcctttcttcaattacgcgatggcacagcaacttttcaaggggtagctctcaaaaacgagctcggtgaaacagcttttgcacaactgaccgacctcgcgcaagaaactagcctctgggtcaccggcacgattcatgcagatacccgttccccctttggctacgagcttgccatctcacaatttgaagtggttgggactagtcacgactacccgatcacgcccaaggaccatggtattgatttcctgttggatcatcgccatctttggctacggtcatcgcgtcccaacgcaattatgcggattcgcaacgaggtcattcgagccgtttatgagttcttcaatgaccgcggttttattaagattgacgcgccgattttgaccggttccgctcctgaagggacaactgaattattcaaaactgattactttggtcaggacgcctatttatcacaatccggccagttatacggtgaagctggcgcaatggcgttcggcaaaatcttcacgtttggaccaacttttcgggccgaaaaatccaagactcgtcgccacttaacagaattctggcaacttgaacctgaaatggcctggatgcatcaagatgaaagtctggaagtccaagaacaattggtggcctacctcgttcaagccgtgattgaccattgcccccacgaactggccgttttggaccgcgatgttgcgacgttgcaaaagtacaccaagctcccatttccgcgagtttcgtacgacgatgctattacactactccaagcaaacggctttgatgtcgactggggtgtcgactttggctcaccggaagagacatttttggcagaacactttgaccaaccagtctttgtcttaaactatcccaaagcaatcaaggccttttacatgcaggcacacccgacgcgcgatgatgtcgtcattgtagctgacctgttagcacctgaaggttacggcgaaattatcggcggttccgaacgctcaacggattatgactacttgaaggaacggttactagccagcggtcaagacttgcaggattacgagtggtatctcgatttacgcaaatatggttcggtgccgcactccggtttcggtatgggtctggaacgttttctggcttggatcactttgcaagatcacgttcgcgaaaccattccgtttccacgtatgttgcaccgtatttacccgtaaagtcgctccaacctagtgctagtagcattggttaatcaaaattaatcgtgcatcctttaaattccccacgcattttcgaatgtgtggggaattttttatcttatttgttgacaagcaacaatattcaagataaaatgttgcttgtcaacaaaattaaggagctgtttaaaatgacaaaattattaatgattaatgctcatccacacacgaccgtccccagtgcctcactgaccgttgcagcgagttttaaaactgcgtatcagcaaacccatccgcacgatgagattacgacacgcgatctttatcaggacggcgttcccgctttgaacgacacaaccttcgaagcttggcgtaaacaaaaatacggtgaagaactaacgtcagtggaagctgaactacttagccgtcacgcctcctggctagctgaatttctagcagccgacaagatcgtcttcgttaatccaatgtacaatcactttcttccagccgaactcaaacaatacttagacttaaccgcagtcgcccgtaaaacttttaagtacacggtcaacggcccggtcggcttattacccgacaaacacgtcttacacattcaggctgcgggtggctactatcaccaacctgatcagcacaaccaggttgaagcaggcgacccctacctccgtggcatgatgcaactgtatgggattcaggattaccgaaccatcttcattgaaggattggaccaatttccagaacagcgagaacaggccatcactgccgcacaggtagcagcagaaaagctcgccggtgaattttaaaaccggtataataatagtaataaaagctaatgattaattgataattgcgcgctaaccaccacgagaaccagccgccatgacgcacaactatctaagggggatcaatcgatgtcaatatccacggaacagacaattctaacgcagctcaaaacgattcgaaccaagcgtgcttccactactggtgaacagaaatggttacagcagcatatcaccgaagccaatctacgccgcctgttgccggatatttccatcgttggcctacatttattatctgaactaaaggccggtccacaaacgggcatcgacttagccactaacctcggcgtcactcgaggtggtgtgacccgggcagccaaacgactcgtaacgcagggcttaattggctcattccagcaacccgatgatcacaaaaagatcttctaccgcttaacgccgagtggtcgtaagctggcccgctatcatgataagatgcatgcaacccgcaatcatcaagcaatcacgctccttcatgaacactactcaccagcagaacttgcggtgattcaacgcttcttggctgatttgacggattatgaagcttaataaaaccaaaaacaccgctacgactaatgcgttcgttagtcacagcggtgtttttgaatttctaatgattagtgattttgtaatcgatacttgcgaattgccataatcaatgacaacgtgttgagtaccaatgataaactgctgaggagtaaactcgtttttgtaatacgcatgagcggcctccattgattgaatttgttaattctagtttaccggtattacgcactaaaagatactaaaagcactaggtgattcgtggattgtgcgatcagtggttaatcatttgacacggtctgttcagcctgggatagcgcgtccttgactgcggccttgatggcacggctcgatacagaagcgccggaaactgcatccacatcataagtgttagcagccaccatttttgccggcaattcggcaactgcctgaccaccaacttcaccagtctcatgttgttcaactacttcaacatgagttaattgttggtcaacatatgtgatacgaaccacaacttgcccaccaatgccatcatctgagcgccctaagtattggtgttcaccaactgtgatgtccggtgatgcttcagctagcaaatcattggcaccagtctgatgcaccgaagcactagtattcgcatccggcttagccactgctttttcatcgactaattgtgtcgtttcttccttaggtttagctgcattttcaccagcgatttttccaaaaatcaggcattcagctaaattaccgccaccttgatactgatttgcacaaataccgcccaactcacctgcaccatacaagtgcggaataggttgctgatttgcatctaaaatctctgcccggtcattacgacgtggccccccttgggtattaagtacgttgtttgttaacttaagcgcataatatggcccaccatcaaatgcccgcatcgtatcaacctgccgattaaacgcgtagtcagtaccagactcaacaaaataattgaaatcatgaacggtcttggtaagtaccgtaccatcaacttccataactcgtgctaagtcgtttagagtagtggccttcacaactaaatcggtgagattattaatcggcgtatattgacttgctaacatctgttgatactgagtttcatcaaaaaccaagtatggatggacatttgtccgcggtactcgccacattccatgatcataaatgtgaccgtgccggttggcttcactctcatcaaaataccgactaccgtcatcagccaccgtaataacgctaccatggttcacttccggccagcctaaaatcaagcgaccacgttcaccttgtggtacggcaatcgaaagaccatgtaaaaatccgagtgattcataattttgcatgtgccaaaagtccgcgccaacttcttgggccatcttaataccagcacccttattaaacagcgtgcctaatggtgccaagtgctcagcaccaaggtagtcctggatggcttgttgattattttcaaaaccaccacatgctaggactacaccattggtagctcgaacattaactaaacgatgctgacgttcgatttggacaccgataattgtattcgtagtgggatcttgaatcagatgttgtgccggagcactaagccagacatcaatctgttgctgccgatctaacactttttgtcgaagaattttccacaaagctgcatcaaaaatgccatgatggacagttgtaaagtcataggattggactccatcaaattcaggaaactcatgaactgcactgtctaatgaaattggagaatcagcagctgtaaaatcatttttgacactcaccgggtcaacattgagatacttttgaacatagtcgcgcatattcgccatgcccgctacgaaagtatcaaccatactatcgtctaattgcatgggtgccgttaagttttgataatattttttaccctcatcgaaactatctaccgttcctaagagttgggcagaataacgggtattgcctccttcatgaccattcggcgctgcatccgtgagcaataccttcgcatgtgcatccgccgcaaaccgcgctgctgtcgccccggcaccaccaaagccaataactaccgtatcatattgataatcccatttaacctgattcatttttttgagcatgctgaccaccctttcaaaatccatttaacgtattctaaagcacaattgaaattgatatttaaatcacaaatagaatcattttttaactacatctgtattatataaccgctttcatttttatagaaataacaatctgattatctgttattacaaatgagtaatgggttatacttgattttaataagattaagcattaaaggtggcgatttcatggaaaataaattgttagtatttttagaagctattcaacagcacaatagtatgacgaaagctgcacaaagtttattcatcagtcagccgtacattagccgcacaattaaaagtgcggaaactcattttgggacccccttaatcgaccgcggccatcatccacttgaattaacttatgctggagaaagattactgacttatttgcaaagtgacgcccgtctccatcagcgaatgaacactgaacttaaagaaatcagtcaaaataagtatcaaagtatgacgattgggattacaccaccaatggctaatgcttggtttagtcaaacactacctgctttttatcaacgttttccgaacattcgcactaaaatactagaaatcacaacatcaaaagcagaaacgttgctagctagtcatcagctagacttttttattggcaaaacaattcatcaaactaacgtcaaaaccatccctttgcagacaatttctttgtctttagtcattccaaaaacagccggaatatatcagtccaatcaattttggcgaccgttcacccccaccattcttacaggaatgactggtgagcctgtcatccgtgcagtcggtgaagctcgctttcaagaactggttgaccattactttgccgataaaggcattcaaacgattccactcattgaagtcgataactctcgctttgcactaagcttgacacttcaaggacttggtagcattgttctagccactgcaatgttggcaagactagccactgaaccagccaagtaccctatcaatgcgttcaaattaccaacaagcgagctcagccttgattttagtattgcctacttaccaagtcacgtgctagctaaaccgattgcttatctagtcgaacaagcttgtcaaacctttaatcctgcgattgatttttaacataaaacgcaaactgtcagcatctattaagctagatgattgacagtttgcgttttactttcaaaataaatcaccggtagtaaatcatgttcaaccccaccagctgttgcattagttgctcattttctggtgatagtttgatttgttgctgccgcagacatttggagatgtctaagttcattctgtcgaatactcccagtactgaaccagttcgttgttccaatagttcctgataataagttgccagcagctgtcgtaacggttgctcattcgtggtatttagattagcaactaaatcactaattatgcccacagcaacacgtgcccgatcctgccccccgctgtaccatttcaccgtcatatctgttcgactccttttacgcaataacaactgccaccatggtcgctgaacaggtcttctgctcaaacctaataactcatccgttgagacagcaaatagtttgctcagtgctaccaataactctaaatctggataactttttcctaattcccacttggaaatagtttgccgtgagacgtgtaaccgctccgccaccgtctgctgggaccattcatgctgttgtcgttgctcttttattttactgccaatcacaattttcatcctacccgctcctctattacaatactagactattgagtgcaccaattcattgcaacacacttaagcgctaccgcaacggttggttgcaaccgctcaagatcaagactcggtatgaaaatgctgatacaacgactttcctgaaactaacaattccacaacttgttgaggatcatcaaccgtcacaccttgtcgttgcaaataactgacaaattgcggtaaatagtcgctggccttcaacgcacattccagctgataagtttgggcattagtctttaaaatcaattgaaaataatccggattgaaatcaaatggtgaaaatcgtttgcgacaccgataactgatggtaactcgctgcagatctgtatagtggattagttggcaccgtggacaattgaacacaatttggcgaaacttcgtcaatgtcgatgcagcatacgtatgcaattcaatggtagcaggctgaatcacccagtaactattgattcccactggaacgaccacaatcaatccaacaatataaagtgataaaaagagccaccacggctgataaccaaaaccagtaaataatagacaaacaaatagccaaaataatccgagacccagaagtcgcccaaagcttagtcgccgaccaacaatatatggctttggaaagaaagcactaccacgcactaattcatccaaggatagattatacagatccgacagtgccagtaaattatcgattgacggaatcgcctttccgcgttcccacttagacaccgcctgagtcgtaacaaataacttggacgctaattgtgcctgtgtcaatccatactgacagcgacgcgttttcaataatgctgcgagtaacattggctcgcccccctttatgatttcagcttaatcctcaaccacgatcaaaccaatcaactcatggttgtttagtcacaatcatgtatggtagtcataatttgttgaacttccgtggttaaatcttgttgctcgccaattaagacttcgttagcaacgcccaacgtatcatgtggaagccaccaccgacgcatgtcttccacaccaaaatcacgatgacgcttttgatgacgcgccaaggtcgtggcaaagctcacttcaaaataataagtaaggacgcgtggaaacgattgactaagccgcgccaacatttttccataccgatcacgtgctaagatgccttccacaatgactacaggcacacgtcccagcccataacacgcaatttgttcaatcagaccaattgaaatatttcccgggtaatcatgactcatcagcatgtcgcgacgaacgacatcttgggacactagcaacgtatgatggcccacgcgtcgttgcaacgcctgcgctagcgtcgtcttgccactcccagaatttccccgaataatcaccaaagttgtttccatccacatgtcctccactcattcctgtatcttaatcataccgcacagctaacaaaaaaacgttagccaaattagctaacgttcgctgatactatttggctttactggcgttacgtcgggcatcatgtaaaatcttcaatgcgcgtttccgcgattttaagttggtcccccgtagacgcctgcgcgcacttgctaaatcttgtttttccatcatgggtgcctcctgataaatagtaat

(The sequence listing continues in the following parts.)

The invention claimed is:

1. A probiotic composition, comprising: *Lactobacillus plantarum* strain deposited under the Budapest Treaty in the Spanish Type Culture Collection (CECT) under accession number CECT 30292, wherein the probiotic composition is a solid composition, comprising:

a freeze-dried bacterial biomass comprising from about $10^5$ cfu to about $10^{12}$ cfu of the strain; a cryoprotectant; and, a pharmaceutically acceptable carrier chosen from an emulsion, a suspension, a gel, a paste, granules, a powder, and a gum.

2. The probiotic composition according to claim 1, further comprising *Lactobacillus plantarum* CECT 7484, *Lactobacillus plantarum* CECT 7485, and *Pediococcus acidilactici* CECT 7483.

3. A method for obtaining a mutant strain of *Lactobacillus plantarum* strain deposited under CECT 30292, comprising the following steps:

(i) making mutants of *L. plantarum* CECT 30292;

(ii) analyzing the in step (i) obtained mutants and identifying a mutant strain that retains or improves at least one ability of the deposited strain; and, (iii) isolating the in step (ii) identified mutant strain to thereby obtain the mutant strain of *L. plantarum* CECT 30292, wherein the mutant strain retains or improves at least one ability of the deposited strain.

* * * * *